(12) United States Patent
Thess

(10) Patent No.: US 9,683,233 B2
(45) Date of Patent: *Jun. 20, 2017

(54) ARTIFICIAL NUCLEIC ACID MOLECULES FOR IMPROVED PROTEIN OR PEPTIDE EXPRESSION

(71) Applicant: CureVac GmbH, Tubingen (DE)

(72) Inventor: Andreas Thess, Kusterdingen (DE)

(73) Assignee: CureVac AG, Tübingen (DE)

( * ) Notice: Subject to any disclaimer, the term of this patent is extended or adjusted under 35 U.S.C. 154(b) by 0 days.

This patent is subject to a terminal disclaimer.

(21) Appl. No.: 14/388,226

(22) PCT Filed: Mar. 27, 2013

(86) PCT No.: PCT/EP2013/000937
§ 371 (c)(1),
(2) Date: Sep. 25, 2014

(87) PCT Pub. No.: WO2013/143699
PCT Pub. Date: Oct. 3, 2013

(65) Prior Publication Data
US 2015/0218554 A1    Aug. 6, 2015

(30) Foreign Application Priority Data

Mar. 27, 2012  (WO) ............... PCT/EP2012/001336
Jun. 8, 2012   (WO) ............... PCT/EP2012/002447

(51) Int. Cl.
| C12N 15/113 | (2010.01) |
| C12Q 1/68   | (2006.01) |
| C12N 15/68  | (2006.01) |
| C12N 15/85  | (2006.01) |
| C12N 15/67  | (2006.01) |
| A61K 48/00  | (2006.01) |

(52) U.S. Cl.
CPC ............ *C12N 15/113* (2013.01); *C12N 15/67* (2013.01); *C12N 15/85* (2013.01); *A61K 48/00* (2013.01); *C12N 2840/105* (2013.01)

(58) Field of Classification Search
None
See application file for complete search history.

(56) References Cited

U.S. PATENT DOCUMENTS

| 8,217,016 | B2  | 7/2012  | Hoerr et al. |
| 8,383,340 | B2  | 2/2013  | Ketterer et al. |
| 8,703,906 | B2  | 4/2014  | Baumhof et al. |
| 8,968,746 | B2  | 3/2015  | Baumhof et al. |
| 9,155,788 | B2  | 10/2015 | Hoerr et al. |
| 2005/0009028 | A1* | 1/2005 | Heintz ............... C12N 15/1006 435/5 |
| 2005/0032730 | A1 | 2/2005 | Von Der Mülbe et al. |
| 2005/0048549 | A1 | 3/2005 | Cao et al. |
| 2005/0059624 | A1 | 3/2005 | Hoerr et al. |
| 2005/0250723 | A1 | 11/2005 | Hoerr et al. |
| 2006/0188490 | A1 | 8/2006 | Hoerr et al. |
| 2007/0172949 | A9 | 7/2007 | Liu et al. |
| 2008/0025944 | A1 | 1/2008 | Hoerr et al. |
| 2008/0267873 | A1 | 10/2008 | Hoerr et al. |
| 2009/0324584 | A1 | 12/2009 | Hoerr et al. |
| 2010/0048883 | A1 | 2/2010 | Ketterer et al. |
| 2010/0120152 | A1 | 5/2010 | Wooddell et al. |
| 2010/0189729 | A1 | 7/2010 | Hoerr et al. |
| 2010/0203076 | A1 | 8/2010 | Fotin-Mleczek et al. |
| 2010/0239608 | A1 | 9/2010 | Von Der Mülbe et al. |
| 2010/0291156 | A1 | 11/2010 | Barner et al. |
| 2010/0303851 | A1 | 12/2010 | Hoerr et al. |
| 2010/0305196 | A1 | 12/2010 | Probst et al. |
| 2011/0053829 | A1 | 3/2011 | Baumhof et al. |
| 2011/0077287 | A1 | 3/2011 | Von Der Mülbe et al. |
| 2011/0250225 | A1 | 10/2011 | Fotin-Mleczek et al. |
| 2011/0269950 | A1 | 11/2011 | Von Der Mülbe et al. |
| 2011/0311472 | A1 | 12/2011 | Hoerr et al. |
| 2012/0009221 | A1 | 1/2012 | Hoerr et al. |
| 2012/0021043 | A1 | 1/2012 | Kramps et al. |
| 2012/0213818 | A1 | 8/2012 | Hoerr et al. |
| 2012/0258046 | A1 | 10/2012 | Mutzke |
| 2013/0121988 | A1 | 5/2013 | Hoerr et al. |
| 2013/0129754 | A1 | 5/2013 | Thess et al. |
| 2013/0195867 | A1 | 8/2013 | Hoerr et al. |
| 2013/0202645 | A1 | 8/2013 | Barner et al. |
| 2013/0251742 | A1 | 9/2013 | Probst et al. |

(Continued)

FOREIGN PATENT DOCUMENTS

| WO | WO 95/15394 | 6/1995 |
| WO | WO 98/42856 | 10/1998 |

(Continued)

OTHER PUBLICATIONS

Ledda (Gene, Jan. 2005, vol. 344, p. 213-220).*
Avni et al., "The 5' terminal oligopyrimidine tract confers translational control on TOP mRNAs in a cell type-and sequence context-dependent manner," *Nucleic Acids Research*, 25(5):995-1001, 1997.
Avni et al., "Vertebrate mRNAs with a 5'-terminal pyrimidine tract are candidates for translational repression in quiescent cells: characterization of the translational cis-regulatory element," *Mol. Cell. Biol.*, 14(6):3822-3833, 1994.
Battle and Doudna, "The stem-loop binding protein forms a highly stable and specific complex with the 3' stem-loop of histone mRNAs," *RNA*, 7:123-132, 2001.
Caldarola et al., "Translational regulation of terminal oligopyrimidine mRNAs induced by serum and amino acids involves distinct signaling events," *The Journal of Biological Chemistry*, 279(14):13522-135531, 2004.

(Continued)

*Primary Examiner* — Channing S Mahatan
(74) *Attorney, Agent, or Firm* — Parker Highlander PLLC

(57) ABSTRACT

The invention relates to an artificial nucleic acid molecule comprising at least one 5'UTR element which is derived from a TOP gene, at least one open reading frame, and preferably at least one histone stem-loop. Optionally the artificial nucleic acid molecule may further comprise, e.g. a poly(A)sequence, a poyladenylation signal, and/or a 3'UTR. The invention further relates to the use of such an artificial nucleic acid molecule in gene therapy and/or genetic vaccination.

22 Claims, 39 Drawing Sheets

(56) References Cited

U.S. PATENT DOCUMENTS

Figure 8:
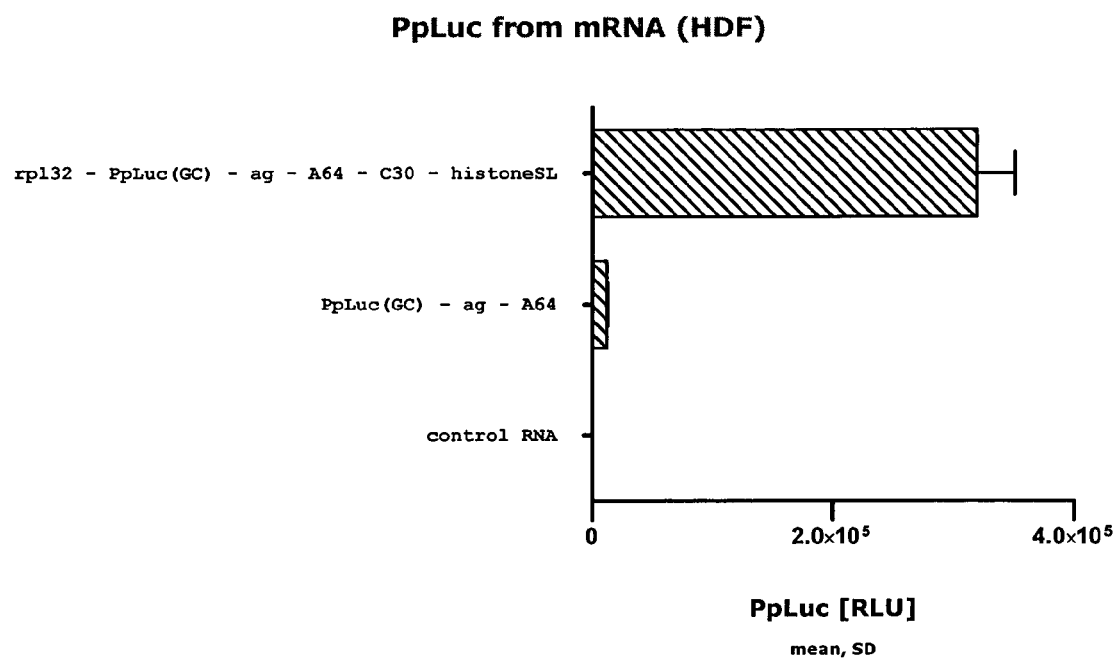

| | | |
|---|---|---|
| 2013/0259879 A1 | 10/2013 | Baumhof et al. |
| 2013/0273001 A1 | 10/2013 | Hoerr et al. |
| 2013/0280283 A1 | 10/2013 | Lorenz et al. |
| 2013/0295043 A1 | 11/2013 | Kallen et al. |
| 2013/0336998 A1 | 12/2013 | Kallen et al. |
| 2014/0037660 A1 | 2/2014 | Fotin-Mleczek et al. |
| 2014/0294877 A1 | 10/2014 | Baumhof et al. |
| 2015/0050302 A1 | 2/2015 | Thess |
| 2015/0057340 A1 | 2/2015 | Thess et al. |
| 2015/0093413 A1 | 4/2015 | Thess |
| 2015/0104476 A1 | 4/2015 | Von Der Mülbe et al. |
| 2015/0118183 A1 | 4/2015 | Baumhof |
| 2015/0118264 A1 | 4/2015 | Baumhof et al. |
| 2015/0141498 A1 | 5/2015 | Mutzke |
| 2015/0165006 A1 | 6/2015 | Thess et al. |
| 2015/0184195 A1 | 7/2015 | Thess et al. |
| 2015/0218554 A1 | 8/2015 | Thess |
| 2015/0258214 A1 | 9/2015 | Baumhof et al. |
| 2015/0306249 A1 | 10/2015 | Baumhof et al. |
| 2015/0320847 A1 | 11/2015 | Thess et al. |

FOREIGN PATENT DOCUMENTS

| | | |
|---|---|---|
| WO | WO 01/12824 | 2/2001 |
| WO | WO 02/098443 | 12/2002 |
| WO | WO 2006/008154 | 1/2006 |
| WO | WO 2006/024518 | 3/2006 |
| WO | WO 2009/030481 | 3/2009 |
| WO | WO 2009/095226 | 8/2009 |
| WO | WO 2010/023260 | 3/2010 |
| WO | WO 2010/132867 | 11/2010 |
| WO | WO 2011/069529 | 6/2011 |
| WO | WO 2012/013326 | 2/2012 |
| WO | WO 2012/019630 | 2/2012 |
| WO | WO 2012/019780 | 2/2012 |
| WO | WO 2012/116714 | 9/2012 |
| WO | WO 2013/120626 | 8/2013 |
| WO | WO 2013/120627 | 8/2013 |
| WO | WO 2013/120628 | 8/2013 |
| WO | WO 2013/120629 | 8/2013 |
| WO | WO 2015/024665 | 2/2015 |
| WO | WO 2015/024668 | 2/2015 |

OTHER PUBLICATIONS

Cameron et al., "Recent advances in transgenic technology," *Molecular Biotechnology*, 7:253-265, 1997.
Chakrabarti et al., "The mammalian target of rapamycin complex 1 regulates leptin biosynthesis in adipocytes at the level of translation: the role of the 5'-untranslated region in the expression of leptin messenger ribonucleic acid," *Molecular Endocrinology*, 22(10):2260-2267, 2008.
Collart et al., "A human histone H2B.1 variant gene, located on chromosome 1, utilizes alternative 3' end processing," *Journal of Cellular Biochemistry*, 50:374-385, 1992.
Damgaard and Lykke-Andersen, "Translational coregulation of 5'TOP mRNAs by TIA-1 and TIAR," *Genes Dev.*, 25:2057-2068, 2011.
Database EMBL Accession No. EM_STD:AB063609, "*Homo sapiens* RPL36AL mRNA for ribosomal protein L36a-like, complete cds," 2002. 1 page.
Database Geneseq Accession No. ATN08647, "Human transcriptional regulatory element SEQ ID No. 6587," 2008, 4 pages.
Davuluri et al., "CART classification of human 5' UTR sequences," *Genome Research*, 10(11):1807-1816, 2000.
Gallie et al., "The histone 3'-terminal stem-loop is necessary for translation in Chinese hamster ovary cells," *Nucleic Acids Res.*, 24(10):1954-1962, 1996.
Gerwitz et al., "Nucleic acid therapeutics: state of the art and future prospects," *Blood*, 92(3):712-736, 1998.
Ginn et al., "Gene therapy clinical trails worldwide to 2012—an update," *Journal of Gene Medicine*, 15:65-77, 2013.

Holtkamp et al., "Modification of antigen-encoding RNA increases stability, translational efficacy, and T-cell stimulatory capacity of dendritic cells," *Blood*, 108(13):4009-17, 2006.
Iadevaia et al., "All translation elongation factors and the e, f, and h subunits of translation initiation factor 3 are encoded by 5'-terminal oligopyrimidine (TOP) mRNAs," *RNA*, 14:1730-1736, 2008.
Kato et al., "Histone H2B as an antigen recognized by lung cancer-specific human monoclonal antibody HB4C5," *Human Antibodies and Hybridomas*, 2(2):94-101, 1991.
Knapinska et al., "Molecular mechanisms regulation mRNA stability: physiological and pathological significance," *Current Genomics*, 6(6):1-16, 2005.
Ledda et al., "Effect of 3' UTR length on the translational regulation of 5'-terminal oligopyrimidine mRNAs," *Gene*, 344:213-220, 2005.
Levy et al., "Oligopyrimidine tract at the 5' end of mammalian ribosomal protein mRNAs is required for their translational control," *Proc. Natl. Acad. Sci. USA*, 88:3319-3323, 1991.
Levy et al., "Sequence and functional characterization of the terminal exon of the human insulin receptor gene," *Biochim Biophys Acta.*, 1263(3):253-257, 1995.
Ling et al., "The histone 3'-terminal stem-loop-binding protein enhances translation through a functional and physical interaction with eukaryotic initiation factor 4G (eIF4G) and eIF3," *Mol Cell Biol.*, 22:7853-7867, 2002.
Lopez and Samuelsson, "Early evolution of histone mRNA 3' end processing," *Bioinformatics*, 14(1):1-10, 2008.
Meyuhas, "Synthesis of the translational apparatus is regulated at the translational level," *Eur. J. Biochem.*, 267:6321-6330, 2000.
Montoliu, "Gene transfer strategies in animal transgenesis," *Cloning and Stem Cells*, 4(1):39-46, 2002.
Narita et al., "NELF interacts with CDC and participates in 3' end processing of replication-dependent histone mRNAs," *Molecular Cell*, 26(3):349-365, 2007.
Niemann, "Transgenic farm animals get off the ground," *Transgenic Research*, 7:73-75, 1998.
Office Action issued in U.S. Appl. No. 13/321,474, mailed Apr. 6, 2015.
Office Action issued in U.S. Appl. No. 13/321,474, mailed May 20, 2014.
Office Action issued in U.S. Appl. No. 14/378,538, mailed Nov. 12, 2015.
Office Action issued in U.S. Appl. No. 14/378,606, mailed May 27, 2015.
Office Action issued in U.S. Appl. No. 14/378,606, mailed Nov. 3, 2015.
Office Action issued in U.S. Appl. No. 14/388,226, mailed Nov. 6, 2015.
Orom et al., "MicroRNA-10a binds the 5'UTR of ribosomal protein mRNAs and enhances their translation," *Molecular Cell*, 30:460-471, 2008.
Pandey et al., "Introns in histone genes alter the distribution of 3' ends," *Nucleic Acids Res.*, 18(11):3161-3170, 1990.
PCT International Search Report and Written Opinion issued in International Application No. PCT/EP2013/000938, mailed Nov. 13, 2013.
PCT International Search Report and Written Opinion issued in International Application No. PCT/EP2013/000461, mailed Apr. 16, 2013.
PCT International Search Report and Written Opinion issued in International Application No. PCT/EP2013/000458, mailed Apr. 24, 2013.
PCT International Search Report and Written Opinion issued in International Application No. PCT/EP2013/000459, mailed Apr. 23, 2013.
PCT International Search Report and Written Opinion issued in International Application No. PCT/EP2013/000460, mailed Apr. 22, 2013.
PCT International Search Report and Written Opinion issued in International Application No. PCT/EP2011/004077, mailed Nov. 10, 2011.
PCT International Search Report and Written Opinion issued in International Application No. PCT/EP2013/000937, mailed Aug. 30, 2013.

(56) References Cited

OTHER PUBLICATIONS

Prelle et al., "Establishment of pluripotent cell lines from vertebrate species—present status and future prospects," *Cells Tissues Organs*, 165:220-236, 1999.
Ristevski, "Making better transgenic models," *Molecular Biotechnology*, 29:153-163, 2005.
Roesler et al., "Immunize and disappear—safety-optimized mRNA vaccination with a panel of 29 allergens," *Journal of Allergy and Clinical Immunology*, 124(5):1070-1077, 2009.
Russell et al., "The stability of human beta-globin mRNA is dependent on structural determinants positioned within its 3' untranslated region," *Blood*, 87:5314-5323, 1996.
Sanchez et al., "Increased levels of polyadenylated histone H2B mRNA accumulate during *Entamoeba invadens* cyst formation," *Molecular and Biochemical Parasitology*, 67(1):137-146, 1994.
Sanchez et al., "The oligo(A) tail on histone mRNA plays an active role in translational silencing of histone mRNA during Xenopus oogenesis," *Mol Cell Biol.*, 24(6):2513-2525, 2004.
Shen et al., "Structures required for poly(A) tail-independent translation overlap with, but ar distinct from, cap-independent translation and RNA replication signals at the 3' end of *Tobacco necrosis* virus RNA," *Virology*, 358:448-458, 2007.
Sigmund, "Viewpoint: are studies in genetically altered mice out of control?" *Arteriosclerosis, Thrombosis, and Vascular Biology*, 20:1425-1429, 2000.
Smith, "Gene transfer in higher animals: theoretical considerations and key concepts," *Journal of Biotechnology*, 99:1-22, 2002.
Stauber et al., "A signal regulating mouse histone H4 mRNA levels in a mammalian cell cycle mutant and sequences controlling RNA 3' processing are both contained within the same 80-bp fragment," *EMBO J.*, 5(12):3297-3303, 1986.
Svoboda et al., "Hairpin RNA; a secondary structure of primary importance," *Cell Mol Life Sci.*, 63(7-8):901-908, 2006.
Thess et al., "Sequence-engineered mRNA without chemical nucleoside modifications enables an effective protein therapy in large animals," *Molecular Therapy*, pp. 1-9 and Supplementary Material, 2015.
Wagner et al., "A genome-wide RNA interference screen reveals that variant histones are necessary for replication-dependent histone pre-mRNA processing", *Molecular Cell*, 28(4):692-699, 2007.
Weiss et al., "Prophylactic mRNA vaccination against allergy," *Current Opinion in Allergy and Clinical Immunology*, 10(6):567-574, 2010.
Williams et al., "A simple, highly efficient method for heterologous expression in mammalian primary neurons using cationic lipid-mediated mRNA transfection," *Frontiers in Neuroscience*, 4:1-20, 2010.
Wooddell et al., "Sustained liver-specific transgene expression from the albumin promoter in mice following hydrodynamic plasmid DNA delivery," *The Journal of Gene Medicine*, 10:551-563, 2008.
Yamashita et al., "Comprehensive detection of human terminal oligo-pyrimidine (TOP) genes and analysis of their characteristics," *Nucleic Acids Res*, 36(11):3707-3715 and Supplementary Data (six pages), 2008.
Zhong et al., "A double-stranded RNA binding protein required for activation of repressed messages in mammalian germ cells," *Nat Genet.*, 22(2):171-174, 1999.
Zhu et al., "Binding of the La autoantigen to the 5' untranslated region of a chimeric human translation elongation factor 1A reporter mRNA inhibits translation in vitro," *Biochimica et Biophysica Acta*, 1521:19-29, 2001.
Eckner et al., "Mature mRNA 3' end formation stimulates RNA export from the nucleus," *The EMBO Journal*, 10(11):3513-3522, 1991.
Gorgon et al., "The stem-loop binding protein stimulates histone translation at an early step in the initiation pathway," *RNA*, 11:1030-1042, 2005.
Office Action issued in U.S. Appl. No. 14/378,538, mailed Jun. 21, 2016.
Office Action issued in U.S. Appl. No. 14/378,572, mailed Aug. 12, 2016.
Office Action issued in U.S. Appl. No. 14/378,572, mailed Mar. 3, 2016.
Office Action issued in U.S. Appl. No. 14/378,591, mailed Aug. 22, 2016.
Office Action issued in U.S. Appl. No. 14/388,224, mailed Apr. 21, 2016.
Dominski et al., "Stem-loop binding protein facilitates 3'-end formation by stabilizing U7 snRNP binding to histone pre-mRNA," *Mol Cell Biol.*, 19(5):3 56 1-3 570, 1999.

* cited by examiner

| #A | #T | #C | #G | Cons | 99% | 95% | 90% |
|---|---|---|---|---|---|---|---|
| 2224 | 172 | 1557 | 25 | N* | H* | M* | M* |
| 1586 | 188 | 2211 | 16 | N* | H* | H* | M* |
| 3075 | 47 | 875 | 4 | N | H | M | M |
| 2872 | 205 | 918 | 6 | N | H | H | M |
| 1284 | 19 | 2675 | 23 | N | V | M | M |
| 184 | 6 | 270 | 3541 | N | V | S | S |
| 0 | 0 | 0 | 4001 | G | G | G | G |
| 13 | 569 | 25 | 3394 | N | Y | Y | Y |
| 12 | 1620 | 27 | 2342 | N | Y | Y | Y |
| 9 | 199 | 3783 | 10 | N | Y | Y | C |
| 1 | 3947 | 51 | 2 | N | Y | T | T |
| 47 | 3830 | 119 | 5 | N | H | T | T |
| 59 | 3704 | 227 | 11 | N | H | Y | T |
| 0 | 4001 | 0 | 0 | T | T | T | T |
| 675 | 182 | 3140 | 4 | N | H | M | M |
| 3818 | 1 | 7 | 175 | N | R | A | A |
| 195 | 21 | 50 | 3735 | N | V | R | G |
| 1596 | 15 | 31 | 2359 | N | V | R | R |
| 523 | 11 | 16 | 3451 | N | R | R | R |
| 0 | 0 | 4001 | 0 | C | C | C | C |
| 14 | 179 | 3543 | 265 | N | B | S | S |
| 3727 | 8 | 154 | 112 | N | V | M | A |
| 61 | 64 | 3870 | 4 | N | H | C | C |
| 771 | 557 | 2636 | 37 | N* | N* | H* | H* |
| 2012 | 201 | 1744 | 43 | N* | N* | H* | M* |
| 2499 | 690 | 674 | 138 | N* | N* | H* | H* |

Brackets on rows indicate: Stem 1 (rows 6–12), Loop (rows 13–16), Stem 2 (rows 17–22).

Figure 1

| 90% | 95% | 99% | Cons | #G | #C | #T | #A | |
|---|---|---|---|---|---|---|---|---|
| N* | N* | N* | N* | 14 | 45 | 20 | 52 | |
| H* | N* | N* | N* | 8 | 59 | 32 | 32 | |
| H | H | N | N | 3 | 20 | 37 | 71 | |
| H | H | N | N | 3 | 25 | 21 | 82 | |
| V | N | N | N | 9 | 38 | 8 | 76 | |
| R | R | D | D | 115 | 0 | 3 | 13 | ⎫ |
| G | G | G | G | 131 | 0 | 0 | 0 | ⎪ |
| N | N | N | N | 12 | 86 | 21 | 12 | ⎬ Stem 1 |
| D | N | N | N | 26 | 8 | 85 | 12 | ⎪ |
| B | N | N | N | 10 | 54 | 58 | 9 | ⎪ |
| Y | Y | B | N | 2 | 42 | 86 | 1 | ⎭ |
| H | H | N | N | 2 | 13 | 70 | 46 | ⎫ |
| Y | B | N | N | 5 | 58 | 65 | 3 | ⎬ Loop |
| T | T | T | T | 0 | 0 | 131 | 0 | ⎪ |
| H | H | H | N | 1 | 27 | 28 | 75 | ⎭ |
| R | R | V | N | 46 | 2 | 1 | 82 | ⎫ |
| D | D | N | N | 55 | 6 | 17 | 53 | ⎪ |
| H | N | N | N | 9 | 31 | 13 | 79 | ⎬ Stem 2 |
| N | N | N | N | 91 | 10 | 10 | 20 | ⎪ |
| C | C | C | C | 0 | 131 | 0 | 0 | ⎪ |
| Y | Y | H | H | 0 | 112 | 15 | 4 | ⎭ |
| R | D | N | N | 25 | 5 | 7 | 94 | |
| H | H | H | N | 1 | 82 | 31 | 17 | |
| H* | H* | N* | N* | 6 | 58 | 32 | 35 | |
| H* | N* | N* | N* | 7 | 30 | 20 | 74 | |
| H* | N* | N* | N* | 7 | 40 | 28 | 56 | |

Figure 2

| | #A | #T | #C | #G | Cons | 99% | 95% | 90% | |
|---|---|---|---|---|---|---|---|---|---|
| | 2172 | 152 | 1512 | 11 | N* | H* | M* | M* | |
| | 1554 | 156 | 2152 | 9 | N* | H* | M* | M* | |
| | 3004 | 10 | 855 | 1 | N | M | M | M | |
| | 2790 | 184 | 893 | 3 | N | H | M | M | |
| | 1208 | 11 | 2637 | 14 | N | M | M | M | |
| ^ | 171 | 3 | 270 | 3426 | N | V | S | S | ⎫ |
| ^ | 0 | 0 | 0 | 3870 | G | G | G | G | ⎪ |
| ^ | 1 | 548 | 3308 | 13 | N | Y | Y | Y | ⎬ Stem 1 |
| ^ | 0 | 1535 | 2334 | 1 | B | Y | Y | Y | ⎪ |
| ^ | 0 | 141 | 3729 | 0 | Y | Y | Y | C | ⎪ |
| ^ | 0 | 9 | 3861 | 0 | Y | T | T | T | ⎭ |
| * | 1 | 3760 | 106 | 3 | N | Y | T | T | ⎫ |
| * | 56 | 3639 | 169 | 6 | N | H | Y | T | ⎬ Loop |
| * | 0 | 3870 | 0 | 0 | T | T | T | T | ⎪ |
| * | 600 | 154 | 3113 | 3 | N | H | M | M | ⎭ |
| v | 3736 | 0 | 5 | 129 | V | R | A | A | ⎫ |
| v | 142 | 4 | 44 | 3680 | N | V | G | G | ⎪ |
| v | 1517 | 2 | 0 | 2351 | D | R | R | R | ⎬ Stem 2 |
| v | 503 | 1 | 6 | 3360 | N | R | R | R | ⎪ |
| v | 0 | 0 | 3870 | 0 | C | C | C | C | ⎪ |
| v | 10 | 164 | 3431 | 265 | N | B | S | S | ⎭ |
| | 3633 | 1 | 149 | 87 | N | V | M | A | |
| | 44 | 33 | 3788 | 3 | N | M | C | C | |
| | 736 | 525 | 2578 | 31 | N* | H* | H* | H* | |
| | 1938 | 181 | 1714 | 36 | N* | H* | H* | M* | |
| | 2443 | 662 | 534 | 131 | N* | N* | H* | H* | |

Figure 3

| #A | #T | #C | #G | Cons | 95% | 95% | 90% | |
|---|---|---|---|---|---|---|---|---|
| 661 | 63 | 601 | 8 | N* | H* | H* | M* | |
| 146 | 121 | 1062 | 4 | N* | H* | H* | M* | |
| 1315 | 2 | 16 | 0 | H | M | A | A | |
| 1323 | 2 | 6 | 2 | N | A | A | A | |
| 920 | 6 | 403 | 4 | N | M | M | M | |
| 8 | 2 | 1 | 1322 | N | G | G | G | ⎫ |
| 0 | 0 | 0 | 1333 | G | G | G | G | ⎪ |
| 1 | 39 | 1293 | 0 | H | Y | C | C | ⎪ |
| 0 | 1217 | 116 | 0 | Y | Y | Y | T | ⎬ Stem 1 |
| 0 | 2 | 1331 | 0 | Y | Y | C | C | ⎪ |
| 0 | 1331 | 2 | 0 | Y | T | T | T | ⎭ |
| 1 | 1329 | 0 | 3 | D | T | T | T | ⎫ |
| 4 | 1207 | 121 | 1 | N | Y | Y | T | ⎬ Loop |
| 0 | 1333 | 0 | 0 | T | T | T | T | ⎪ |
| 441 | 30 | 862 | 0 | H | H | M | M | ⎭ |
| 1333 | 0 | 0 | 0 | A | A | A | A | ⎫ |
| 0 | 1 | 2 | 1330 | B | G | G | G | ⎪ |
| 1199 | 0 | 0 | 134 | R | R | R | R | ⎪ |
| 21 | 1 | 0 | 1311 | D | R | G | C | ⎬ Stem 2 |
| 0 | 0 | 1333 | 0 | C | C | C | C | ⎪ |
| 1 | 2 | 1328 | 2 | N | C | C | C | ⎭ |
| 1126 | 1 | 128 | 78 | N | V | V | M | |
| 26 | 22 | 1284 | 1 | N | H | C | C | |
| 81 | 91 | 1143 | 18 | N* | N* | H* | Y* | |
| 380 | 91 | 834 | 28 | N* | N* | H* | M* | |
| 960 | 12 | 361 | 0 | H* | M* | M* | M* | |

Figure 4

| #A | #T | #C | #G | Cons | 99% | 95% | 90% | |
|---|---|---|---|---|---|---|---|---|
| 10 | 8 | 62 | 4 | N* | N* | H* | H* | |
| 17 | 6 | 61 | 0 | H* | H* | H* | M* | |
| 84 | 0 | 0 | 0 | A | A | A | A | |
| 84 | 0 | 0 | 0 | A | A | A | A | |
| 76 | 2 | 6 | 0 | H | H | W | A | |
| 1 | 2 | 0 | 81 | G | G | G | G | ⎫ |
| 0 | 0 | 0 | 84 | G | G | G | G | ⎪ |
| 1 | 1 | 82 | 0 | H | H | C | C | ⎬ Stem 1 |
| 0 | 67 | 17 | 0 | Y | Y | Y | Y | ⎪ |
| 0 | 0 | 84 | 0 | C | C | C | C | ⎪ |
| 0 | 0 | 84 | 0 | T | T | T | T | ⎭ |
| 1 | 80 | 0 | 3 | D | D | T | T | ⎫ |
| 0 | 81 | 3 | 0 | Y | Y | T | T | ⎪ |
| 0 | 84 | 0 | 0 | T | T | T | T | ⎬ Loop |
| 12 | 5 | 67 | 0 | H | H | H | M | ⎭ |
| 84 | 0 | 0 | 0 | A | A | A | A | ⎫ |
| 0 | 0 | 1 | 83 | S | S | G | G | ⎪ |
| 0 | 0 | 0 | 19 | R | R | R | R | ⎬ Stem 2 |
| 3 | 0 | 0 | 81 | R | R | G | G | ⎪ |
| 0 | 0 | 84 | 0 | C | C | C | C | ⎪ |
| 0 | 0 | 84 | 0 | C | C | C | C | ⎭ |
| 69 | 0 | 5 | 10 | V | V | V | R | |
| 5 | 4 | 75 | 0 | H | H | M | M | |
| 0 | 25 | 57 | 2 | B* | B* | Y* | Y* | |
| 10 | 24 | 44 | 6 | N* | N* | N* | H* | |
| 64 | 3 | 17 | 0 | H* | H* | H* | M* | |

Figure 5 mRNA nucleotide sequence of PpLuc(GC) – ag – A64

GGGAGAAAGCTTGAGGATGGAGGACGCCAAGAACATCAAGAAGGGCCCGGCGCCCTTCTA
CCCGCTGGAGGACGGGACCGCCGGCGAGCAGCTCCACAAGGCCATGAAGCGGTACGCCCT
GGTGCCGGGCACGATCGCCTTCACCGACGCCCACATCGAGGTCGACATCACCTACGCGGA
GTACTTCGAGATGAGCGTGCGCCTGGCCGAGGCCATGAAGCGGTACGGCCTGAACACCAA
CCACCGGATCGTGGTGTGCTCGGAGAACAGCCTGCAGTTCTTCATGCCGGTGCTGGGCGC
CCTCTTCATCGGCGTGGCCGTCGCCCCGGCGAACGACATCTACAACGAGCGGGAGCTGCT
GAACAGCATGGGGATCAGCCAGCCGACCGTGGTGTTCGTGAGCAAGAAGGGCCTGCAGAA
GATCCTGAACGTGCAGAAGAAGCTGCCCATCATCCAGAAGATCATCATGGACAGCAA
GACCGACTACCAGGGCTTCCAGTCGATGTACACGTTCGTGACCAGCCACCTCCCGCCGGG
CTTCAACGAGTACGACTTCGTCCCGGAGAGCTTCGACCGGGACAAGACCATCGCCCTGAT
CATGAACAGCAGCGGCAGCACCGGCCTGCCGAAGGGGGTGGCCCTGCCGCACCGGACCGC
CTGCGTGCGCTTCTCGCACGCCCGGGACCCCATCTTCGGCAACCAGATCATCCCGGACAC
CGCCATCCTGAGCGTGGTGCCGTTCCACCACGGCTTCGGCATGTTCACGACCCTGGGCTA
CCTCATCTGCGGCTTCCGGGTGGTCCTGATGTACCGGTTCGAGGAGGAGCTGTTCCTGCG
GAGCCTGCAGGACTACAAGATCCAGAGCGCGCTGCTCGTGCCGACCCTGTTCAGCTTCTT
CGCCAAGAGCACCCTGATCGACAAGTACGACCTGTCGAACCTGCACGAGATCGCCAGCGG
GGGCGCCCCGCTGAGCAAGGAGGTGGGCGAGGCCGTGGCCAAGCGGTTCCACCTCCCGGG
CATCCGCCAGGGCTACGGCCTGACCGAGACCACGAGCGCGATCCTGATCACCCCCGAGGG
GGACGACAAGCCGGGCGCCGTGGGCAAGGTGGTCCCGTTCTTCGAGGCCAAGGTGGTGGA
CCTGGACACCGGCAAGACCCTGGGCGTGAACCAGCGGGGCGAGCTGTGCGTGCGGGGGCC
GATGATCATGAGCGGCTACGTGAACAACCCGGAGGCCACCAACGCCCTCATCGACAAGGA
CGGCTGGCTGCACAGCGGCGACATCGCCTACTGGGACGAGGACGAGCACTTCTTCATCGT
CGACCGGCTGAAGTCGCTGATCAAGTACAAGGGCTACCAGGTGGCGCCGGCCGAGCTGGA
GAGCATCCTGCTCCAGCACCCCAACATCTTCGACGCCGGCGTGGCCGGGCTGCCGGACGA
CGACGCCGGCGAGCTGCCGGCCGCGGTGGTGGTGCTGGAGCACGGCAAGACCATGACGGA
GAAGGAGATCGTCGACTACGTGGCCAGCCAGGTGACCACCGCCAAGAAGCTGCGGGGCGG
CGTGGTGTTCGTGGACGAGGTCCCGAAGGGCCTGACCGGGAAGCTCGACGCCCGGAAGAT
CCGCGAGATCCTGATCAAGGCCAAGAAGGGCGGCAAGATCGCCGTGTAAGACTAGTTATA
AGACTGACTAGCCCGATGGGCCTCCCAACGGGCCCTCCTCCCCTCCTTGCACCGAGATTA
ATAGATCTAAAAAAAAAAAAAAAAAAAAAAAAAAAAAAAAAAAAAAAAAAAAAAAAAAAA
AAAAAAAAAAA

Figure 6 nucleotide sequence of RPL32 – PpLuc(GC) – ag – A64 – C30 – histoneSL

GGGGCGCTGCCTACGGAGGTGGCAGCCATCTCCTTCTCGGCATCAAGCTTGAGGATGGAG
GACGCCAAGAACATCAAGAAGGGCCCGGCGCCCTTCTACCCGCTGGAGGACGGGACCGCC
GGCGAGCAGCTCCACAAGGCCATGAAGCGGTACGCCCTGGTGCCGGGCACGATCGCCTTC
ACCGACGCCCACATCGAGGTCGACATCACCTACGCGGAGTACTTCGAGATGAGCGTGCGC
CTGGCCGAGGCCATGAAGCGGTACGGCCTGAACACCAACCACCGGATCGTGGTGTGCTCG
GAGAACAGCCTGCAGTTCTTCATGCCGGTGCTGGGCGCCCTCTTCATCGGCGTGGCCGTC
GCCCCGGCGAACGACATCTACAACGAGCGGGAGCTGCTGAACAGCATGGGGATCAGCCAG
CCGACCGTGGTGTTCGTGAGCAAGAAGGGCCTGCAGAAGATCCTGAACGTGCAGAAGAAG
CTGCCCATCATCCAGAAGATCATCATCATGGACAGCAAGACCGACTACCAGGGCTTCCAG
TCGATGTACACGTTCGTGACCAGCCACCTCCCGCCGGGCTTCAACGAGTACGACTTCGTC
CCGGAGAGCTTCGACCGGGACAAGACCATCGCCCTGATCATGAACAGCAGCGGCAGCACC
GGCCTGCCGAAGGGGGTGGCCCTGCCGCACCGGACCGCCTGCGTGCGCTTCTCGCACGCC
CGGGACCCCATCTTCGGCAACCAGATCATCCCGGACACCGCCATCCTGAGCGTGGTGCCG
TTCCACCACGGCTTCGGCATGTTCACGACCCTGGGCTACCTCATCTGCGGCTTCCGGGTG
GTCCTGATGTACCGGTTCGAGGAGGAGCTGTTCCTGCGGAGCCTGCAGGACTACAAGATC
CAGAGCGCGCTGCTCGTGCCGACCCTGTTCAGCTTCTTCGCCAAGAGCACCCTGATCGAC
AAGTACGACCTGTCGAACCTGCACGAGATCGCCAGCGGGGGCGCCCCGCTGAGCAAGGAG
GTGGGCGAGGCCGTGGCCAAGCGGTTCCACCTCCCGGGCATCCGCCAGGGCTACGGCCTG
ACCGAGACCACGAGCGCGATCCTGATCACCCCCGAGGGGACGACAAGCCGGGCGCCGTG
GGCAAGGTGGTCCCGTTCTTCGAGGCCAAGGTGGTGGACCTGGACACCGGCAAGACCCTG
GGCGTGAACCAGCGGGGCGAGCTGTGCGTGCGGGGCCGATGATCATGAGCGGCTACGTG
AACAACCCGGAGGCCACCAACGCCCTCATCGACAAGGACGGCTGGCTGCACAGCGGCGAC
ATCGCCTACTGGGACGAGGACGAGCACTTCTTCATCGTCGACCGGCTGAAGTCGCTGATC
AAGTACAAGGGCTACCAGGTGGCGCCGGCCGAGCTGGAGAGCATCCTGCTCCAGCACCCC
AACATCTTCGACGCCGGCGTGGCCGGGCTGCCGGACGACGACGCCGGCGAGCTGCCGGCC
GCGGTGGTGGTGCTGGAGCACGGCAAGACCATGACGGAGAAGGAGATCGTCGACTACGTG
GCCAGCCAGGTGACCACCGCCAAGAAGCTGCGGGGCGGCGTGGTGTTCGTGGACGAGGTC
CCGAAGGGCCTGACCGGGAAGCTCGACGCCCGGAAGATCCGCGAGATCCTGATCAAGGCC
AAGAAGGGCGGCAAGATCGCCGTGTAAGACTAGTTATAAGACTGACTAGCCCGATGGGCC
TCCCAACGGGCCCTCCTCCCCTCCTTGCACCGAGATTAATAGATCTAAAAAAAAAAAAAA
AAAAAAAAAAAAAAAAAAAAAAAAAAAAAAAAAAAAAAAAAAAAAAAAAAAATGCATCCCCC
CCCCCCCCCCCCCCCCCCCCCCCAAAGGCTCTTTTCAGAGCCACCAGAATT

Figure 7 nucleotide sequence of PpLuc(GC) – ag – A64 – histoneSL

GGGAGAAAGCTTGAGGATGGAGGACGCCAAGAACATCAAGAAGGGCCCGGCGCCCTTCTA
CCCGCTGGAGGACGGGACCGCCGGCGAGCAGCTCCACAAGGCCATGAAGCGGTACGCCCT
GGTGCCGGGCACGATCGCCTTCACCGACGCCCACATCGAGGTCGACATCACCTACGCGGA
GTACTTCGAGATGAGCGTGCGCCTGGCCGAGGCCATGAAGCGGTACGGCCTGAACACCAA
CCACCGGATCGTGGTGTGCTCGGAGAACAGCCTGCAGTTCTTCATGCCGGTGCTGGGCGC
CCTCTTCATCGGCGTGGCCGTCGCCCCGGCAACGACATCTACAACGAGCGGGAGCTGCT
GAACAGCATGGGGATCAGCCAGCCGACCGTGGTGTTCGTGAGCAAGAAGGGCCTGCAGAA
GATCCTGAACGTGCAGAAGAAGCTGCCCATCATCCAGAAGATCATCATCATGGACAGCAA
GACCGACTACCAGGGCTTCCAGTCGATGTACACGTTCGTGACCAGCCACCTCCCGCCGGG
CTTCAACGAGTACGACTTCGTCCCGGAGAGCTTCGACCGGGACAAGACCATCGCCCTGAT
CATGAACAGCAGCGGCAGCACCGGCCTGCCGAAGGGGGTGGCCCTGCCGCACCGGACCGC
CTGCGTGCGCTTCTCGCACGCCCGGGACCCCATCTTCGGCAACCAGATCATCCCGGACAC
CGCCATCCTGAGCGTGGTGCCGTTCCACCACGGCTTCGGCATGTTCACGACCCTGGGCTA
CCTCATCTGCGGCTTCCGGGTGGTCCTGATGTACCGGTTCGAGGAGGAGCTGTTCCTGCG
GAGCCTGCAGGACTACAAGATCCAGAGCGCGCTGCTCGTGCCGACCCTGTTCAGCTTCTT
CGCCAAGAGCACCCTGATCGACAAGTACGACCTGTCGAACCTGCACGAGATCGCCAGCGG
GGGCGCCCCGCTGAGCAAGGAGGTGGGCGAGGCCGTGGCCAAGCGGTTCCACCTCCCGGG
CATCCGCCAGGGCTACGGCCTGACCGAGACCACGAGCGCGATCCTGATCACCCCCGAGGG
GGACGACAAGCCGGGCGCCGTGGGCAAGGTGGTCCCGTTCTTCGAGGCCAAGGTGGTGGA
CCTGGACACCGGCAAGACCCTGGGCGTGAACCAGCGGGGCGAGCTGTGCGTGCGGGGGCC
GATGATCATGAGCGGCTACGTGAACAACCCGGAGGCCACCAACGCCCTCATCGACAAGGA
CGGCTGGCTGCACAGCGGCGACATCGCCTACTGGGACGAGGACGAGCACTTCTTCATCGT
CGACCGGCTGAAGTCGCTGATCAAGTACAAGGGCTACCAGGTGGCGCCGGCCGAGCTGGA
GAGCATCCTGCTCCAGCACCCCAACATCTTCGACGCCGGCGTGGCCGGGCTGCCGGACGA
CGACGCCGGCGAGCTGCCGGCCGCGGTGGTGGTGCTGGAGCACGGCAAGACCATGACGGA
GAAGGAGATCGTCGACTACGTGGCCAGCCAGGTGACCACCGCCAAGAAGCTGCGGGGCGG
CGTGGTGTTCGTGGACGAGGTCCCGAAGGGCCTGACCGGGAAGCTCGACGCCCGGAAGAT
CCGCGAGATCCTGATCAAGGCCAAGAAGGGCGGCAAGATCGCCGTGTAAGACTAGTTATA
AGACTGACTAGCCCGATGGGCCTCCCAACGGGCCCTCCTCCCCTCCTTGCACCGAGATTA
ATAAAAAAAAAAAAAAAAAAAAAAAAAAAAAAAAAAAAAAAAAAAAAAAAAAAAAAAAAA
AAAAAATGCATCAAAGGCTCTTTTCAGAGCCACCA

Figure 9 nucleotide sequence of RPL32 – PpLuc(GC) – ag – A64

GGGGCGCTGCCTACGGAGGTGGCAGCCATCTCCTTCTCGGCATCAAGCTTGAGGATGGAG
GACGCCAAGAACATCAAGAAGGGCCCGGCGCCCTTCTACCCGCTGGAGGACGGGACCGCC
GGCGAGCAGCTCCACAAGGCCATGAAGCGGTACGCCCTGGTGCCGGGCACGATCGCCTTC
ACCGACGCCCACATCGAGGTCGACATCACCTACGCGGAGTACTTCGAGATGAGCGTGCGC
CTGGCCGAGGCCATGAAGCGGTACGGCCTGAACACCAACCACCGGATCGTGGTGTGCTCG
GAGAACAGCCTGCAGTTCTTCATGCCGGTGCTGGGCGCCCTCTTCATCGGCGTGGCCGTC
GCCCCGGCGAACGACATCTACAACGAGCGGGAGCTGCTGAACAGCATGGGGATCAGCCAG
CCGACCGTGGTGTTCGTGAGCAAGAAGGGCCTGCAGAAGATCCTGAACGTGCAGAAGAAG
CTGCCCATCATCCAGAAGATCATCATCATGGACAGCAAGACCGACTACCAGGGCTTCCAG
TCGATGTACACGTTCGTGACCAGCCACCTCCCGCCGGGCTTCAACGAGTACGACTTCGTC
CCGGAGAGCTTCGACCGGGACAAGACCATCGCCCTGATCATGAACAGCAGCGGCAGCACC
GGCCTGCCGAAGGGGGTGGCCCTGCCGCACCGGACCGCCTGCGTGCGCTTCTCGCACGCC
CGGGACCCCATCTTCGGCAACCAGATCATCCCGGACACCGCCATCCTGAGCGTGGTGCCG
TTCCACCACGGCTTCGGCATGTTCACGACCCTGGGCTACCTCATCTGCGGCTTCCGGGTG
GTCCTGATGTACCGGTTCGAGGAGGAGCTGTTCCTGCGGAGCCTGCAGGACTACAAGATC
CAGAGCGCGCTGCTCGTGCCGACCCTGTTCAGCTTCTTCGCCAAGAGCACCCTGATCGAC
AAGTACGACCTGTCGAACCTGCACGAGATCGCCAGCGGGGGCGCCCCGCTGAGCAAGGAG
GTGGGCGAGGCCGTGGCCAAGCGGTTCCACCTCCCGGGCATCCGCCAGGGCTACGGCCTG
ACCGAGACCACGAGCGCGATCCTGATCACCCCCGAGGGGACGACAAGCCGGGCGCCGTG
GGCAAGGTGGTCCCGTTCTTCGAGGCCAAGGTGGTGGACCTGGACACCGGCAAGACCCTG
GGCGTGAACCAGCGGGGCGAGCTGTGCGTGCGGGGCCGATGATCATGAGCGGCTACGTG
AACAACCCGGAGGCCACCAACGCCCTCATCGACAAGGACGGCTGGCTGCACAGCGGCGAC
ATCGCCTACTGGGACGAGGACGAGCACTTCTTCATCGTCGACCGGCTGAAGTCGCTGATC
AAGTACAAGGGCTACCAGGTGGCGCCGGCCGAGCTGGAGAGCATCCTGCTCCAGCACCCC
AACATCTTCGACGCCGGCGTGGCCGGGCTGCCGGACGACGACGCCGGCGAGCTGCCGGCC
GCGGTGGTGGTGCTGGAGCACGGCAAGACCATGACGGAGAAGGAGATCGTCGACTACGTG
GCCAGCCAGGTGACCACCGCCAAGAAGCTGCGGGGCGGCGTGGTGTTCGTGGACGAGGTC
CCGAAGGGCCTGACCGGGAAGCTCGACGCCCGGAAGATCCGCGAGATCCTGATCAAGGCC
AAGAAGGGCGGCAAGATCGCCGTGTAAGACTAGTTATAAGACTGACTAGCCCGATGGGCC
TCCCAACGGGCCCTCCTCCCCTCCTTGCACCGAGATTAATAGATCTAAAAAAAAAAAAAA
AAAAAAAAAAAAAAAAAAAAAAAAAAAAAAAAAAAAAAAAAAAAAAAAA

Figure 10 nucleotide sequence of RPL32 – PpLuc(GC) – ag – A64 – histoneSL

GGGGCGCTGCCTACGGAGGTGGCAGCCATCTCCTTCTCGGCATCAAGCTTGAGGATGGAG
GACGCCAAGAACATCAAGAAGGGCCCGGCGCCCTTCTACCCGCTGGAGGACGGGACCGCC
GGCGAGCAGCTCCACAAGGCCATGAAGCGGTACGCCCTGGTGCCGGGCACGATCGCCTTC
ACCGACGCCCACATCGAGGTCGACATCACCTACGCGGAGTACTTCGAGATGAGCGTGCGC
CTGGCCGAGGCCATGAAGCGGTACGGCCTGAACACCAACCACCGGATCGTGGTGTGCTCG
GAGAACAGCCTGCAGTTCTTCATGCCGGTGCTGGGCGCCCTCTTCATCGGCGTGGCCGTC
GCCCCGGCGAACGACATCTACAACGAGCGGGAGCTGCTGAACAGCATGGGGATCAGCCAG
CCGACCGTGGTGTTCGTGAGCAAGAAGGGCCTGCAGAAGATCCTGAACGTGCAGAAGAAG
CTGCCCATCATCCAGAAGATCATCATCATGGACAGCAAGACCGACTACCAGGGCTTCCAG
TCGATGTACACGTTCGTGACCAGCCACCTCCCGCCGGGCTTCAACGAGTACGACTTCGTC
CCGGAGAGCTTCGACCGGGACAAGACCATCGCCCTGATCATGAACAGCAGCGGCAGCACC
GGCCTGCCGAAGGGGGTGGCCCTGCCGCACCGGACGCCTGCGTGCGCTTCTCGCACGCC
CGGGACCCCATCTTCGGCAACCAGATCATCCCGGACACCGCCATCCTGAGCGTGGTGCCG
TTCCACCACGGCTTCGGCATGTTCACGACCCTGGGCTACCTCATCTGCGGCTTCCGGGTG
GTCCTGATGTACCGGTTCGAGGAGGAGCTGTTCCTGCGGAGCCTGCAGGACTACAAGATC
CAGAGCGCGCTGCTCGTGCCGACCCTGTTCAGCTTCTTCGCCAAGAGCACCCTGATCGAC
AAGTACGACCTGTCGAACCTGCACGAGATCGCCAGCGGGGCGCCCCGCTGAGCAAGGAG
GTGGGCGAGGCCGTGGCCAAGCGGTTCCACCTCCCGGGCATCCGCCAGGGCTACGGCCTG
ACCGAGACCACGAGCGCGATCCTGATCACCCCCGAGGGGGACGACAAGCCGGGCGCCGTG
GGCAAGGTGGTCCCGTTCTTCGAGGCCAAGGTGGTGGACCTGGACACCGGCAAGACCCTG
GGCGTGAACCAGCGGGGCGAGCTGTGCGTGCGGGGCCGATGATCATGAGCGGCTACGTG
AACAACCCGGAGGCCACCAACGCCCTCATCGACAAGGACGGCTGGCTGCACAGCGGCGAC
ATCGCCTACTGGGACGAGGACGAGCACTTCTTCATCGTCGACCGGCTGAAGTCGCTGATC
AAGTACAAGGGCTACCAGGTGGCGCCGGCCGAGCTGGAGAGCATCCTGCTCCAGCACCCC
AACATCTTCGACGCCGGCGTGGCCGGGCTGCCGGACGACGACGCCGGCGAGCTGCCGGCC
GCGGTGGTGGTGCTGGAGCACGGCAAGACCATGACGGAGAAGGAGATCGTCGACTACGTG
GCCAGCCAGGTGACCACCGCCAAGAAGCTGCGGGGCGGCGTGGTGTTCGTGGACGAGGTC
CCGAAGGGCCTGACCGGGAAGCTCGACGCCCGGAAGATCCGCGAGATCCTGATCAAGGCC
AAGAAGGGCGGCAAGATCGCCGTGTAAGACTAGTTATAAGACTGACTAGCCCGATGGGCC
TCCCAACGGGCCCTCCTCCCCTCCTTGCACCGAGATTAATAAAAAAAAAAAAAAAAAAAA
AAAAAAAAAAAAAAAAAAAAAAAAAAAAAAAAAAAAAAAAAAAATGCATCAAAGGCTCTT
TTCAGAGCCACCA

Figure 11 nucleotide sequence of RPL32 – PpLuc(GC) – albumin7 – A64 – C30 – histoneSL

GGGGCGCTGCCTACGGAGGTGGCAGCCATCTCCTTCTCGGCATCAAGCTTGAGGATGGAG
GACGCCAAGAACATCAAGAAGGGCCCGGCGCCCTTCTACCCGCTGGAGGACGGGACCGCC
GGCGAGCAGCTCCACAAGGCCATGAAGCGGTACGCCCTGGTGCCGGGCACGATCGCCTTC
ACCGACGCCCACATCGAGGTCGACATCACCTACGCGGAGTACTTCGAGATGAGCGTGCGC
CTGGCCGAGGCCATGAAGCGGTACGGCCTGAACACCAACCACCGGATCGTGGTGTGCTCG
GAGAACAGCCTGCAGTTCTTCATGCCGGTGCTGGGCGCCCTCTTCATCGGCGTGGCCGTC
GCCCCGGCGAACGACATCTACAACGAGCGGGAGCTGCTGAACAGCATGGGGATCAGCCAG
CCGACCGTGGTGTTCGTGAGCAAGAAGGGCCTGCAGAAGATCCTGAACGTGCAGAAGAAG
CTGCCCATCATCCAGAAGATCATCATCATGGACAGCAAGACCGACTACCAGGGCTTCCAG
TCGATGTACACGTTCGTGACCAGCCACCTCCCGCCGGGCTTCAACGAGTACGACTTCGTC
CCGGAGAGCTTCGACCGGGACAAGACCATCGCCCTGATCATGAACAGCAGCGGCAGCACC
GGCCTGCCGAAGGGGGTGGCCCTGCCGCACCGGACCGCCTGCGTGCGCTTCTCGCACGCC
CGGGACCCCATCTTCGGCAACCAGATCATCCCGGACACCGCCATCCTGAGCGTGGTGCCG
TTCCACCACGGCTTCGGCATGTTCACGACCCTGGGCTACCTCATCTGCGGCTTCCGGGTG
GTCCTGATGTACCGGTTCGAGGAGGAGCTGTTCCTGCGGAGCCTGCAGGACTACAAGATC
CAGAGCGCGCTGCTCGTGCCGACCCTGTTCAGCTTCTTCGCCAAGAGCACCCTGATCGAC
AAGTACGACCTGTCGAACCTGCACGAGATCGCCAGCGGGGGCGCCCCGCTGAGCAAGGAG
GTGGGCGAGGCCGTGGCCAAGCGGTTCCACCTCCCGGGCATCCGCCAGGGCTACGGCCTG
ACCGAGACCACGAGCGCGATCCTGATCACCCCCGAGGGGGACGACAAGCCGGGCGCCGTG
GGCAAGGTGGTCCCGTTCTTCGAGGCCAAGGTGGTGGACCTGGACACCGGCAAGACCCTG
GGCGTGAACCAGCGGGGCGAGCTGTGCGTGCGGGGCCGATGATCATGAGCGGCTACGTG
AACAACCCGGAGGCCACCAACGCCCTCATCGACAAGGACGGCTGGCTGCACAGCGGCGAC
ATCGCCTACTGGGACGAGGACGAGCACTTCTTCATCGTCGACCGGCTGAAGTCGCTGATC
AAGTACAAGGGCTACCAGGTGGCGCCGGCCGAGCTGGAGAGCATCCTGCTCCAGCACCCC
AACATCTTCGACGCCGGCGTGGCCGGGCTGCCGGACGACGACGCCGGCGAGCTGCCGGCC
GCGGTGGTGGTGCTGGAGCACGGCAAGACCATGACGGAGAAGGAGATCGTCGACTACGTG
GCCAGCCAGGTGACCACCGCCAAGAAGCTGCGGGGCGGCGTGGTGTTCGTGGACGAGGTC
CCGAAGGGCCTGACCGGGAAGCTCGACGCCCGGAAGATCCGCGAGATCCTGATCAAGGCC
AAGAAGGGCGGCAAGATCGCCGTGTAAGACTAGTGCATCACATTTAAAAGCATCTCAGCC
TACCATGAGAATAAGAGAAAGAAAATGAAGATCAATAGCTTATTCATCTCTTTTTCTTTT
TCGTTGGTGTAAAGCCAACACCCTGTCTAAAAAACATAAATTTCTTTAATCATTTTGCCT
CTTTTCTCTGTGCTTCAATTAATAAAAAATGGAAAGAACCTAGATCTAAAAAAAAAAAAA
AAAAAAAAAAAAAAAAAAAAAAAAAAAAAAAAAAAAAAAAAAAAAAAAAATGCATCCCC
CCCCCCCCCCCCCCCCCCCCCCCCCAAAGGCTCTTTTCAGAGCCACCAGAATT

Figure 13 nucleotide sequence of RPL35 – PpLuc(GC) – albumin7 – A64 – C30 – histoneSL

GGGGAGCGGGCGGCGGCGTTGGCGGCTTGTGCAGCAAAGCTTGAGGATGGAGGACGCCAA
GAACATCAAGAAGGGCCCGGCGCCCTTCTACCCGCTGGAGGACGGGACCGCCGGCGAGCA
GCTCCACAAGGCCATGAAGCGGTACGCCCTGGTGCCGGGCACGATCGCCTTCACCGACGC
CCACATCGAGGTCGACATCACCTACGCGGAGTACTTCGAGATGAGCGTGCGCCTGGCCGA
GGCCATGAAGCGGTACGGCCTGAACACCAACCACCGGATCGTGGTGTGCTCGGAGAACAG
CCTGCAGTTCTTCATGCCGGTGCTGGGCGCCCTCTTCATCGGCGTGGCCGTCGCCCCGGC
GAACGACATCTACAACGAGCGGGAGCTGCTGAACAGCATGGGGATCAGCCAGCCGACCGT
GGTGTTCGTGAGCAAGAAGGGCCTGCAGAAGATCCTGAACGTGCAGAAGAAGCTGCCCAT
CATCCAGAAGATCATCATCATGGACAGCAAGACCGACTACCAGGGCTTCCAGTCGATGTA
CACGTTCGTGACCAGCCACCTCCCGCCGGGCTTCAACGAGTACGACTTCGTCCCGGAGAG
CTTCGACCGGGACAAGACCATCGCCCTGATCATGAACAGCAGCGGCAGCACCGGCCTGCC
GAAGGGGGTGGCCCTGCCGCACCGGACCGCCTGCGTGCGCTTCTCGCACGCCCGGGACCC
CATCTTCGGCAACCAGATCATCCCGGACACCGCCATCCTGAGCGTGGTGCCGTTCCACCA
CGGCTTCGGCATGTTCACGACCCTGGGCTACCTCATCTGCGGCTTCCGGGTGGTCCTGAT
GTACCGGTTCGAGGAGGAGCTGTTCCTGCGGAGCCTGCAGGACTACAAGATCCAGAGCGC
GCTGCTCGTGCCGACCCTGTTCAGCTTCTTCGCCAAGAGCACCCTGATCGACAAGTACGA
CCTGTCGAACCTGCACGAGATCGCCAGCGGGGCGCCCCGCTGAGCAAGGAGGTGGGCGA
GGCCGTGGCCAAGCGGTTCCACCTCCCGGGCATCCGCCAGGGCTACGGCCTGACCGAGAC
CACGAGCGCGATCCTGATCACCCCCGAGGGGACGACAAGCCGGGCGCCGTGGGCAAGGT
GGTCCCGTTCTTCGAGGCCAAGGTGGTGGACCTGGACACCGGCAAGACCCTGGGCGTGAA
CCAGCGGGGCGAGCTGTGCGTGCGGGGCCGATGATCATGAGCGGCTACGTGAACAACCC
GGAGGCCACCAACGCCCTCATCGACAAGGACGGCTGGCTGCACAGCGGCGACATCGCCTA
CTGGGACGAGGACGAGCACTTCTTCATCGTCGACCGGCTGAAGTCGCTGATCAAGTACAA
GGGCTACCAGGTGGCGCCGGCCGAGCTGGAGAGCATCCTGCTCCAGCACCCCAACATCTT
CGACGCCGGCGTGGCCGGGCTGCCGGACGACGACGCCGGCGAGCTGCCGGCCGCGGTGGT
GGTGCTGGAGCACGGCAAGACCATGACGGAGAAGGAGATCGTCGACTACGTGGCCAGCCA
GGTGACCACCGCCAAGAAGCTGCGGGGCGGCGTGGTGTTCGTGGACGAGGTCCCGAAGGG
CCTGACCGGGAAGCTCGACGCCCGGAAGATCCGCGAGATCCTGATCAAGGCCAAGAAGGG
CGGCAAGATCGCCGTGTAAGACTAGTGCATCACATTTAAAAGCATCTCAGCCTACCATGA
GAATAAGAGAAAGAAAATGAAGATCAATAGCTTATTCATCTCTTTTTCTTTTTCGTTGGT
GTAAAGCCAACACCCTGTCTAAAAAACATAAATTTCTTTAATCATTTTGCCTCTTTTCTC
TGTGCTTCAATTAATAAAAAATGGAAAGAACCTAGATCTAAAAAAAAAAAAAAAAAAAAA
AAAAAAAAAAAAAAAAAAAAAAAAAAAAAAAAAAAAAAAAAATGCATCCCCCCCCCCCC
CCCCCCCCCCCCCCCCCAAAGGCTCTTTTCAGAGCCACCAGAATT

Figure 14 nucleotide sequence of RPL21 – PpLuc(GC) – albumin7 – A64 – C30 – histoneSL

```
GGGGCCGGAACCGCCATCTTCCAGTAATTCGCCAAAAAGCTTGAGGATGGAGGACGCCAA
GAACATCAAGAAGGGCCCGGCGCCCTTCTACCCGCTGGAGGACGGGACCGCCGGCGAGCA
GCTCCACAAGGCCATGAAGCGGTACGCCCTGGTGCCGGGCACGATCGCCTTCACCGACGC
CCACATCGAGGTCGACATCACCTACGCGGAGTACTTCGAGATGAGCGTGCGCCTGGCCGA
GGCCATGAAGCGGTACGGCCTGAACACCAACCACCGGATCGTGGTGTGCTCGGAGAACAG
CCTGCAGTTCTTCATGCCGGTGCTGGGCGCCCTCTTCATCGGCGTGGCCGTCGCCCCGGC
GAACGACATCTACAACGAGCGGGAGCTGCTGAACAGCATGGGGATCAGCCAGCCGACCGT
GGTGTTCGTGAGCAAGAAGGGCCTGCAGAAGATCCTGAACGTGCAGAAGAAGCTGCCCAT
CATCCAGAAGATCATCATCATGGACAGCAAGACCGACTACCAGGGCTTCCAGTCGATGTA
CACGTTCGTGACCAGCCACCTCCCGCCGGGCTTCAACGAGTACGACTTCGTCCCGGAGAG
CTTCGACCGGGACAAGACCATCGCCCTGATCATGAACAGCAGCGGCAGCACCGGCCTGCC
GAAGGGGGTGGCCCTGCCGCACCGGACCGCCTGCGTGCGCTTCTCGCACGCCCGGGACCC
CATCTTCGGCAACCAGATCATCCCGGACACCGCCATCCTGAGCGTGGTGCCGTTCCACCA
CGGCTTCGGCATGTTCACGACCCTGGGCTACCTCATCTGCGGCTTCCGGGTGGTCCTGAT
GTACCGGTTCGAGGAGGAGCTGTTCCTGCGGAGCCTGCAGGACTACAAGATCCAGAGCGC
GCTGCTCGTGCCGACCCTGTTCAGCTTCTTCGCCAAGAGCACCCTGATCGACAAGTACGA
CCTGTCGAACCTGCACGAGATCGCCAGCGGGGCGCCCCGCTGAGCAAGGAGGTGGGCGA
GGCCGTGGCCAAGCGGTTCCACCTCCCGGGCATCCGCCAGGGCTACGGCCTGACCGAGAC
CACGAGCGCGATCCTGATCACCCCCGAGGGGACGACAAGCCGGGCGCCGTGGGCAAGGT
GGTCCCGTTCTTCGAGGCCAAGGTGGTGGACCTGGACACCGGCAAGACCCTGGGCGTGAA
CCAGCGGGGCGAGCTGTGCGTGCGGGGCCGATGATCATGAGCGGCTACGTGAACAACCC
GGAGGCCACCAACGCCCTCATCGACAAGGACGGCTGGCTGCACAGCGGCGACATCGCCTA
CTGGGACGAGGACGAGCACTTCTTCATCGTCGACCGGCTGAAGTCGCTGATCAAGTACAA
GGGCTACCAGGTGGCGCCGGCCGAGCTGGAGAGCATCCTGCTCCAGCACCCCAACATCTT
CGACGCCGGCGTGGCCGGGCTGCCGGACGACGACGCCGGCGAGCTGCCGGCCGCGGTGGT
GGTGCTGGAGCACGGCAAGACCATGACGGAGAAGGAGATCGTCGACTACGTGGCCAGCCA
GGTGACCACCGCCAAGAAGCTGCGGGGCGGCGTGGTGTTCGTGGACGAGGTCCCGAAGGG
CCTGACCGGGAAGCTCGACGCCCGGAAGATCCGCGAGATCCTGATCAAGGCCAAGAAGGG
CGGCAAGATCGCCGTGTAAGACTAGTGCATCACATTTAAAAGCATCTCAGCCTACCATGA
GAATAAGAGAAAGAAAATGAAGATCAATAGCTTATTCATCTCTTTTTCTTTTTCGTTGGT
GTAAAGCCAACACCCTGTCTAAAAAACATAAATTTCTTTAATCATTTTGCCTCTTTTCTC
TGTGCTTCAATTAATAAAAAATGGAAAGAACCTAGATCTAAAAAAAAAAAAAAAAAAAAA
AAAAAAAAAAAAAAAAAAAAAAAAAAAAAAAAAAAAAAAAAAATGCATCCCCCCCCCCC
CCCCCCCCCCCCCCCCCCAAAGGCTCTTTTCAGAGCCACCAGAATT
```

Figure 15 nucleotide sequence of atp5a1 – PpLuc(GC) – albumin7 – A64 – C30 – histoneSL

GGGCGGCTCGGCCATTTTGTCCCAGTCAGTCCGGAGGCTGCGGCTGCAGAAGTACCGCCT
GCGGAGTAACTGCAAAGAAGCTTGAGGATGGAGGACGCCAAGAACATCAAGAAGGGCCCG
GCGCCCTTCTACCCGCTGGAGGACGGGACCGCCGGCGAGCAGCTCCACAAGGCCATGAAG
CGGTACGCCCTGGTGCCGGGCACGATCGCCTTCACCGACGCCCACATCGAGGTCGACATC
ACCTACGCGGAGTACTTCGAGATGAGCGTGCGCCTGGCCGAGGCCATGAAGCGGTACGGC
CTGAACACCAACCACCGGATCGTGGTGTGCTCGGAGAACAGCCTGCAGTTCTTCATGCCG
GTGCTGGGCGCCCTCTTCATCGGCGTGGCCGTCGCCCCGGCGAACGACATCTACAACGAG
CGGGAGCTGCTGAACAGCATGGGGATCAGCCAGCCGACCGTGGTGTTCGTGAGCAAGAAG
GGCCTGCAGAAGATCCTGAACGTGCAGAAGAAGCTGCCCATCATCCAGAAGATCATCATC
ATGGACAGCAAGACCGACTACCAGGGCTTCCAGTCGATGTACACGTTCGTGACCAGCCAC
CTCCCGCCGGGCTTCAACGAGTACGACTTCGTCCCGGAGAGCTTCGACCGGGACAAGACC
ATCGCCCTGATCATGAACAGCAGCGGCAGCACCGGCCTGCCGAAGGGGGTGGCCCTGCCG
CACCGGACCGCCTGCGTGCGCTTCTCGCACGCCCGGGACCCCATCTTCGGCAACCAGATC
ATCCCGGACACCGCCATCCTGAGCGTGGTGCCGTTCCACCACGGCTTCGGCATGTTCACG
ACCCTGGGCTACCTCATCTGCGGCTTCCGGGTGGTCCTGATGTACCGGTTCGAGGAGGAG
CTGTTCCTGCGGAGCCTGCAGGACTACAAGATCCAGAGCGCGCTGCTCGTGCCGACCCTG
TTCAGCTTCTTCGCCAAGAGCACCCTGATCGACAAGTACGACCTGTCGAACCTGCACGAG
ATCGCCAGCGGGGGCGCCCCGCTGAGCAAGGAGGTGGGCGAGGCCGTGGCCAAGCGGTTC
CACCTCCCGGGCATCCGCCAGGGCTACGGCCTGACCGAGACCACGAGCGCGATCCTGATC
ACCCCCGAGGGGGACGACAAGCCGGGCGCCGTGGGCAAGGTGGTCCCGTTCTTCGAGGCC
AAGGTGGTGGACCTGGACACCGGCAAGACCCTGGGCGTGAACCAGCGGGGCGAGCTGTGC
GTGCGGGGGCCGATGATCATGAGCGGCTACGTGAACAACCCGGAGGCCACCAACGCCCTC
ATCGACAAGGACGGCTGGCTGCACAGCGGCGACATCGCCTACTGGGACGAGGACGAGCAC
TTCTTCATCGTCGACCGGCTGAAGTCGCTGATCAAGTACAAGGGCTACCAGGTGGCGCCG
GCCGAGCTGGAGAGCATCCTGCTCCAGCACCCCAACATCTTCGACGCCGGCGTGGCCGGG
CTGCCGGACGACGACGCCGGCGAGCTGCCGGCCGCGGTGGTGGTGCTGGAGCACGGCAAG
ACCATGACGGAGAAGGAGATCGTCGACTACGTGGCCAGCCAGGTGACCACCGCCAAGAAG
CTGCGGGGCGGCGTGGTGTTCGTGGACGAGGTCCCGAAGGGCCTGACCGGGAAGCTCGAC
GCCCGGAAGATCCGCGAGATCCTGATCAAGGCCAAGAAGGGCGGCAAGATCGCCGTGTAA
GACTAGTGCATCACATTTAAAAGCATCTCAGCCTACCATGAGAATAAGAGAAAGAAAATG
AAGATCAATAGCTTATTCATCTCTTTTTCTTTTTCGTTGGTGTAAAGCCAACACCCTGTC
TAAAAAACATAAATTTCTTTAATCATTTTGCCTCTTTTCTCTGTGCTTCAATTAATAAAA
AATGGAAAGAACCTAGATCTAAAAAAAAAAAAAAAAAAAAAAAAAAAAAAAAAAAAAAAA
AAAAAAAAAAAAAAAAAAAAAATGCATCCCCCCCCCCCCCCCCCCCCCCCCCCCCCC
AAAGGCTCTTTTCAGAGCCACCAGAATT

Figure 16 nucleotide sequence of HSD17B4 – PpLuc(GC) – albumin7 – A64 – C30 – histoneSL

GGGTCCCGCAGTCGGCGTCCAGCGGCTCTGCTTGTTCGTGTGTGTGTCGTTGCAGGCCTT
ATTCAAGCTTGAGGATGGAGGACGCCAAGAACATCAAGAAGGGCCCCGGCGCCCTTCTACC
CGCTGGAGGACGGGACCGCCGGCGAGCAGCTCCACAAGGCCATGAAGCGGTACGCCCTGG
TGCCGGGCACGATCGCCTTCACCGACGCCCACATCGAGGTCGACATCACCTACGCGGAGT
ACTTCGAGATGAGCGTGCGCCTGGCCGAGGCCATGAAGCGGTACGGCCTGAACACCAACC
ACCGGATCGTGGTGTGCTCGGAGAACAGCCTGCAGTTCTTCATGCCGGTGCTGGGCGCCC
TCTTCATCGGCGTGGCCGTCGCCCCGGCGAACGACATCTACAACGAGCGGGAGCTGCTGA
ACAGCATGGGGATCAGCCAGCCGACCGTGGTGTTCGTGAGCAAGAAGGGCCTGCAGAAGA
TCCTGAACGTGCAGAAGAAGCTGCCCATCATCCAGAAGATCATCATCATGGACAGCAAGA
CCGACTACCAGGGCTTCCAGTCGATGTACACGTTCGTGACCAGCCACCTCCCGCCGGGCT
TCAACGAGTACGACTTCGTCCCGGAGAGCTTCGACCGGGACAAGACCATCGCCCTGATCA
TGAACAGCAGCGGCAGCACCGGCCTGCCGAAGGGGGTGGCCCTGCCGCACCGGACCGCCT
GCGTGCGCTTCTCGCACGCCCGGGACCCCATCTTCGGCAACCAGATCATCCCGGACACCG
CCATCCTGAGCGTGGTGCCGTTCCACCACGGCTTCGGCATGTTCACGACCCTGGGCTACC
TCATCTGCGGCTTCCGGGTGGTCCTGATGTACCGGTTCGAGGAGGAGCTGTTCCTGCGGA
GCCTGCAGGACTACAAGATCCAGAGCGCGCTGCTCGTGCCGACCCTGTTCAGCTTCTTCG
CCAAGAGCACCCTGATCGACAAGTACGACCTGTCGAACCTGCACGAGATCGCCAGCGGGG
GCGCCCCGCTGAGCAAGGAGGTGGGCGAGGCCGTGGCCAAGCGGTTCCACCTCCCGGGCA
TCCGCCAGGGCTACGGCCTGACCGAGACCACGAGCGCGATCCTGATCACCCCCGAGGGGG
ACGACAAGCCGGGCGCCGTGGGCAAGGTGGTCCCGTTCTTCGAGGCCAAGGTGGTGGACC
TGGACACCGGCAAGACCCTGGGCGTGAACCAGCGGGGCGAGCTGTGCGTGCGGGGCCGA
TGATCATGAGCGGCTACGTGAACAACCCGGAGGCCACCAACGCCCTCATCGACAAGGACG
GCTGGCTGCACAGCGGCGACATCGCCTACTGGGACGAGGACGAGCACTTCTTCATCGTCG
ACCGGCTGAAGTCGCTGATCAAGTACAAGGGCTACCAGGTGGCGCCGGCCGAGCTGGAGA
GCATCCTGCTCCAGCACCCCAACATCTTCGACGCCGGCGTGGCCGGGCTGCCGGACGACG
ACGCCGGCGAGCTGCCGGCCGCGGTGGTGGTGCTGGAGCACGGCAAGACCATGACGGAGA
AGGAGATCGTCGACTACGTGGCCAGCCAGGTGACCACCGCCAAGAAGCTGCGGGGCGGCG
TGGTGTTCGTGGACGAGGTCCCGAAGGGCCTGACCGGGAAGCTCGACGCCCGGAAGATCC
GCGAGATCCTGATCAAGGCCAAGAAGGGCGGCAAGATCGCCGTGTAAGACTAGTGCATCA
CATTTAAAAGCATCTCAGCCTACCATGAGAATAAGAGAAAGAAAATGAAGATCAATAGCT
TATTCATCTCTTTTTCTTTTTCGTTGGTGTAAAGCCAACACCCTGTCTAAAAAACATAAA
TTTCTTTAATCATTTGCCTCTTTTCTCTGTGCTTCAATTAATAAAAAATGGAAAGAACC
TAGATCTAAAAAAAAAAAAAAAAAAAAAAAAAAAAAAAAAAAAAAAAAAAAAAAAAAAAA
AAAAAAAAAAATGCATCCCCCCCCCCCCCCCCCCCCCCCCCCCCCAAAGGCTCTTTTC
AGAGCCACCAGAATT

Figure 17 nucleotide sequence of AlG1 – PpLuc(GC) – albumin7 – A64 – C30 – histoneSL

GGGCCGCCCAGCCGGTCCAGGCCTCTGGCGAACAAGCTTGAGGATGGAGGACGCCAAGAA
CATCAAGAAGGGCCCGGCGCCCTTCTACCCGCTGGAGGACGGGACCGCCGGCGAGCAGCT
CCACAAGGCCATGAAGCGGTACGCCCTGGTGCCGGGCACGATCGCCTTCACCGACGCCCA
CATCGAGGTCGACATCACCTACGCGGAGTACTTCGAGATGAGCGTGCGCCTGGCCGAGGC
CATGAAGCGGTACGGCCTGAACACCAACCACCGGATCGTGGTGTGCTCGGAGAACAGCCT
GCAGTTCTTCATGCCGGTGCTGGGCGCCCTCTTCATCGGCGTGGCCGTCGCCCCGGCGAA
CGACATCTACAACGAGCGGGAGCTGCTGAACAGCATGGGGATCAGCCAGCCGACCGTGGT
GTTCGTGAGCAAGAAGGGCCTGCAGAAGATCCTGAACGTGCAGAAGAAGCTGCCCATCAT
CCAGAAGATCATCATCATGGACAGCAAGACCGACTACCAGGGCTTCCAGTCGATGTACAC
GTTCGTGACCAGCCACCTCCCGCCGGGCTTCAACGAGTACGACTTCGTCCCGGAGAGCTT
CGACCGGGACAAGACCATCGCCCTGATCATGAACAGCAGCGGCAGCACCGGCCTGCCGAA
GGGGGTGGCCCTGCCGCACCGGACCGCCTGCGTGCGCTTCTCGCACGCCCGGGACCCCAT
CTTCGGCAACCAGATCATCCCGGACACCGCCATCCTGAGCGTGGTGCCGTTCCACCACGG
CTTCGGCATGTTCACGACCCTGGGCTACCTCATCTGCGGCTTCCGGGTGGTCCTGATGTA
CCGGTTCGAGGAGGAGCTGTTCCTGCGGAGCCTGCAGGACTACAAGATCCAGAGCGCGCT
GCTCGTGCCGACCCTGTTCAGCTTCTTCGCCAAGAGCACCCTGATCGACAAGTACGACCT
GTCGAACCTGCACGAGATCGCCAGCGGGGGCGCCCCGCTGAGCAAGGAGGTGGGCGAGGC
CGTGGCCAAGCGGTTCCACCTCCCGGGCATCCGCCAGGGCTACGGCCTGACCGAGACCAC
GAGCGCGATCCTGATCACCCCCGAGGGGACGACAAGCCGGGCGCCGTGGGCAAGGTGGT
CCCGTTCTTCGAGGCCAAGGTGGTGGACCTGGACACCGGCAAGACCCTGGGCGTGAACCA
GCGGGGCGAGCTGTGCGTGCGGGGCCGATGATCATGAGCGGCTACGTGAACAACCCGGA
GGCCACCAACGCCCTCATCGACAAGGACGGCTGGCTGCACAGCGGCGACATCGCCTACTG
GGACGAGGACGAGCACTTCTTCATCGTCGACCGGCTGAAGTCGCTGATCAAGTACAAGGG
CTACCAGGTGGCGCCGGCCGAGCTGGAGAGCATCCTGCTCCAGCACCCCAACATCTTCGA
CGCCGGCGTGGCCGGGCTGCCGGACGACGACGCCGGCGAGCTGCCGGCCGCGGTGGTGGT
GCTGGAGCACGGCAAGACCATGACGGAGAAGGAGATCGTCGACTACGTGGCCAGCCAGGT
GACCACCGCCAAGAAGCTGCGGGGCGGCGTGGTGTTCGTGGACGAGGTCCCGAAGGGCCT
GACCGGGAAGCTCGACGCCCGGAAGATCCGCGAGATCCTGATCAAGGCCAAGAAGGGCGG
CAAGATCGCCGTGTAAGACTAGTGCATCACATTTAAAAGCATCTCAGCCTACCATGAGAA
TAAGAGAAAGAAAATGAAGATCAATAGCTTATTCATCTCTTTTTCTTTTTCGTTGGTGTA
AAGCCAACACCCTGTCTAAAAAACATAAATTTCTTTAATCATTTTGCCTCTTTTCTCTGT
GCTTCAATTAATAAAAAATGGAAAGAACCTAGATCTAAAAAAAAAAAAAAAAAAAAAAAA
AAAAAAAAAAAAAAAAAAAAAAAAAAAAAAAAAAAAAAAATGCATCCCCCCCCCCCCCC
CCCCCCCCCCCCCCAAAGGCTCTTTTCAGAGCCACCAGAATT

Figure 18 nucleotide sequence of COX6C – PpLuc(GC) – albumin7 – A64 – C30 – histoneSL

```
GGAGTCAGGAAGGACGTTGGTGTTGAGGTTAGCATACGTATCAAGGACAGTAACTACCAA
GCTTGAGGATGGAGGACGCCAAGAACATCAAGAAGGGCCCGGCGCCCTTCTACCCGCTGG
AGGACGGGACCGCCGGCGAGCAGCTCCACAAGGCCATGAAGCGGTACGCCCTGGTGCCGG
GCACGATCGCCTTCACCGACGCCCACATCGAGGTCGACATCACCTACGCGGAGTACTTCG
AGATGAGCGTGCGCCTGGCCGAGGCCATGAAGCGGTACGGCCTGAACACCAACCACCGGA
TCGTGGTGTGCTCGGAGAACAGCCTGCAGTTCTTCATGCCGGTGCTGGGCGCCCTCTTCA
TCGGCGTGGCCGTCGCCCCGGCGAACGACATCTACAACGAGCGGGAGCTGCTGAACAGCA
TGGGGATCAGCCAGCCGACCGTGGTGTTCGTGAGCAAGAAGGGCCTGCAGAAGATCCTGA
ACGTGCAGAAGAAGCTGCCCATCATCCAGAAGATCATCATCATGGACAGCAAGACCGACT
ACCAGGGCTTCCAGTCGATGTACACGTTCGTGACCAGCCACCTCCCGCCGGGCTTCAACG
AGTACGACTTCGTCCCGGAGAGCTTCGACCGGGACAAGACCATCGCCCTGATCATGAACA
GCAGCGGCAGCACCGGCCTGCCGAAGGGGGTGGCCCTGCCGCACCGGACCGCCTGCGTGC
GCTTCTCGCACGCCCGGGACCCCATCTTCGGCAACCAGATCATCCCGGACACCGCCATCC
TGAGCGTGGTGCCGTTCCACCACGGCTTCGGCATGTTCACGACCCTGGGCTACCTCATCT
GCGGCTTCCGGGTGGTCCTGATGTACCGGTTCGAGGAGGAGCTGTTCCTGCGGAGCCTGC
AGGACTACAAGATCCAGAGCGCGCTGCTCGTGCCGACCCTGTTCAGCTTCTTCGCCAAGA
GCACCCTGATCGACAAGTACGACCTGTCGAACCTGCACGAGATCGCCAGCGGGGGCGCCC
CGCTGAGCAAGGAGGTGGGCGAGGCCGTGGCCAAGCGGTTCCACCTCCCGGGCATCCGCC
AGGGCTACGGCCTGACCGAGACCACGAGCGCGATCCTGATCACCCCCGAGGGGACGACA
AGCCGGGCGCCGTGGGCAAGGTGGTCCCGTTCTTCGAGGCCAAGGTGGTGGACCTGGACA
CCGGCAAGACCCTGGGCGTGAACCAGCGGGGCGAGCTGTGCGTGCGGGGCCGATGATCA
TGAGCGGCTACGTGAACAACCCGGAGGCCACCAACGCCCTCATCGACAAGGACGGCTGGC
TGCACAGCGGCGACATCGCCTACTGGGACGAGGACGAGCACTTCTTCATCGTCGACCGGC
TGAAGTCGCTGATCAAGTACAAGGGCTACCAGGTGGCGCCGGCCGAGCTGGAGAGCATCC
TGCTCCAGCACCCCAACATCTTCGACGCCGGCGTGGCCGGGCTGCCGGACGACGACGCCG
GCGAGCTGCCGGCCGCGGTGGTGGTGCTGGAGCACGGCAAGACCATGACGGAGAAGGAGA
TCGTCGACTACGTGGCCAGCCAGGTGACCACCGCCAAGAAGCTGCGGGGCGGCGTGGTGT
TCGTGGACGAGGTCCCGAAGGGCCTGACCGGGAAGCTCGACGCCCGGAAGATCCGCGAGA
TCCTGATCAAGGCCAAGAAGGGCGGCAAGATCGCCGTGTAAGACTAGTGCATCACATTTA
AAAGCATCTCAGCCTACCATGAGAATAAGAGAAAGAAAATGAAGATCAATAGCTTATTCA
TCTCTTTTTCTTTTTCGTTGGTGTAAAGCCAACACCCTGTCTAAAAAACATAAATTTCTT
TAATCATTTTGCCTCTTTTCTCTGTGCTTCAATTAATAAAAAATGGAAAGAACCTAGATC
TAAAAAAAAAAAAAAAAAAAAAAAAAAAAAAAAAAAAAAAAAAAAAAAAAAAAAAAAAAA
AAAAATGCATCCCCCCCCCCCCCCCCCCCCCCCCCCCCAAAGGCTCTTTTCAGAGCC
ACCAGAATT
```

Figure 19 nucleotide sequence of ASAH1 – PpLuc(GC) – albumin7 – A64 – C30 – histoneSL

GGGCCTCTGCTGGAGTCCGGGGAGTGGCGTTGGCTGCTAGAGCGAAGCTTGAGGATGGAG
GACGCCAAGAACATCAAGAAGGGCCCGGCGCCCTTCTACCCGCTGGAGGACGGGACCGCC
GGCGAGCAGCTCCACAAGGCCATGAAGCGGTACGCCCTGGTGCCGGGCACGATCGCCTTC
ACCGACGCCCACATCGAGGTCGACATCACCTACGCGGAGTACTTCGAGATGAGCGTGCGC
CTGGCCGAGGCCATGAAGCGGTACGGCCTGAACACCAACCACCGGATCGTGGTGTGCTCG
GAGAACAGCCTGCAGTTCTTCATGCCGGTGCTGGGCGCCCTCTTCATCGGCGTGGCCGTC
GCCCCGGCGAACGACATCTACAACGAGCGGGAGCTGCTGAACAGCATGGGGATCAGCCAG
CCGACCGTGGTGTTCGTGAGCAAGAAGGGCCTGCAGAAGATCCTGAACGTGCAGAAGAAG
CTGCCCATCATCCAGAAGATCATCATCATGGACAGCAAGACCGACTACCAGGGCTTCCAG
TCGATGTACACGTTCGTGACCAGCCACCTCCCGCCGGGCTTCAACGAGTACGACTTCGTC
CCGGAGAGCTTCGACCGGGACAAGACCATCGCCCTGATCATGAACAGCAGCGGCAGCACC
GGCCTGCCGAAGGGGGTGGCCCTGCCGCACCGGACCGCCTGCGTGCGCTTCTCGCACGCC
CGGGACCCCATCTTCGGCAACCAGATCATCCCGGACACCGCCATCCTGAGCGTGGTGCCG
TTCCACCACGGCTTCGGCATGTTCACGACCCTGGGCTACCTCATCTGCGGCTTCCGGGTG
GTCCTGATGTACCGGTTCGAGGAGGAGCTGTTCCTGCGGAGCCTGCAGGACTACAAGATC
CAGAGCGCGCTGCTCGTGCCGACCCTGTTCAGCTTCTTCGCCAAGAGCACCCTGATCGAC
AAGTACGACCTGTCGAACCTGCACGAGATCGCCAGCGGGGGCGCCCCGCTGAGCAAGGAG
GTGGGCGAGGCCGTGGCCAAGCGGTTCCACCTCCCGGGCATCCGCCAGGGCTACGGCCTG
ACCGAGACCACGAGCGCGATCCTGATCACCCCCGAGGGGGACGACAAGCCGGGCGCCGTG
GGCAAGGTGGTCCCGTTCTTCGAGGCCAAGGTGGTGGACCTGGACACCGGCAAGACCCTG
GGCGTGAACCAGCGGGGCGAGCTGTGCGTGCGGGGGCCGATGATCATGAGCGGCTACGTG
AACAACCCGGAGGCCACCAACGCCCTCATCGACAAGGACGGCTGGCTGCACAGCGGCGAC
ATCGCCTACTGGGACGAGGACGAGCACTTCTTCATCGTCGACCGGCTGAAGTCGCTGATC
AAGTACAAGGGCTACCAGGTGGCGCCGGCCGAGCTGGAGAGCATCCTGCTCCAGCACCCC
AACATCTTCGACGCCGGCGTGGCCGGGCTGCCGGACGACGACGCCGGCGAGCTGCCGGCC
GCGGTGGTGGTGCTGGAGCACGGCAAGACCATGACGGAGAAGGAGATCGTCGACTACGTG
GCCAGCCAGGTGACCACCGCCAAGAAGCTGCGGGGCGGCGTGGTGTTCGTGGACGAGGTC
CCGAAGGGCCTGACCGGGAAGCTCGACGCCCGGAAGATCCGCGAGATCCTGATCAAGGCC
AAGAAGGGCGGCAAGATCGCCGTGTAAGACTAGTGCATCACATTTAAAAGCATCTCAGCC
TACCATGAGAATAAGAGAAAGAAAATGAAGATCAATAGCTTATTCATCTCTTTTTCTTTT
TCGTTGGTGTAAAGCCAACACCCTGTCTAAAAAACATAAATTTCTTTAATCATTTTGCCT
CTTTTCTCTGTGCTTCAATTAATAAAAAATGGAAAGAACCTAGATCTAAAAAAAAAAAAA
AAAAAAAAAAAAAAAAAAAAAAAAAAAAAAAAAAAAAAAAAAAAAAAAAAATGCATCCCC
CCCCCCCCCCCCCCCCCCCCCCCAAAGGCTCTTTTCAGAGCCACCAGAATT

Figure 20 nucleotide sequence of RPL35 – PpLuc(GC) – ag – A64

```
GGGGAGCGGGCGGCGGCGTTGGCGGCTTGTGCAGCAAAGCTTGAGGATGGAGGACGCCAA
GAACATCAAGAAGGGCCCGGCGCCCTTCTACCCGCTGGAGGACGGGACCGCCGGCGAGCA
GCTCCACAAGGCCATGAAGCGGTACGCCCTGGTGCCGGGCACGATCGCCTTCACCGACGC
CCACATCGAGGTCGACATCACCTACGCGGAGTACTTCGAGATGAGCGTGCGCCTGGCCGA
GGCCATGAAGCGGTACGGCCTGAACACCAACCACCGGATCGTGGTGTGCTCGGAGAACAG
CCTGCAGTTCTTCATGCCGGTGCTGGGCGCCCTCTTCATCGGCGTGGCCGTCGCCCCGGC
GAACGACATCTACAACGAGCGGGAGCTGCTGAACAGCATGGGGATCAGCCAGCCGACCGT
GGTGTTCGTGAGCAAGAAGGGCCTGCAGAAGATCCTGAACGTGCAGAAGAAGCTGCCCAT
CATCCAGAAGATCATCATCATGGACAGCAAGACCGACTACCAGGGCTTCCAGTCGATGTA
CACGTTCGTGACCAGCCACCTCCCGCCGGGCTTCAACGAGTACGACTTCGTCCCGGAGAG
CTTCGACCGGGACAAGACCATCGCCCTGATCATGAACAGCAGCGGCAGCACCGGCCTGCC
GAAGGGGGTGGCCCTGCCGCACCGGACCGCCTGCGTGCGCTTCTCGCACGCCCGGGACCC
CATCTTCGGCAACCAGATCATCCCGGACACCGCCATCCTGAGCGTGGTGCCGTTCCACCA
CGGCTTCGGCATGTTCACGACCCTGGGCTACCTCATCTGCGGCTTCCGGGTGGTCCTGAT
GTACCGGTTCGAGGAGGAGCTGTTCCTGCGGAGCCTGCAGGACTACAAGATCCAGAGCGC
GCTGCTCGTGCCGACCCTGTTCAGCTTCTTCGCCAAGAGCACCCTGATCGACAAGTACGA
CCTGTCGAACCTGCACGAGATCGCCAGCGGGGGCGCCCCGCTGAGCAAGGAGGTGGGCGA
GGCCGTGGCCAAGCGGTTCCACCTCCCGGGCATCCGCCAGGGCTACGGCCTGACCGAGAC
CACGAGCGCGATCCTGATCACCCCCGAGGGGGACGACAAGCCGGGCGCCGTGGGCAAGGT
GGTCCCGTTCTTCGAGGCCAAGGTGGTGGACCTGGACACCGGCAAGACCCTGGGCGTGAA
CCAGCGGGGCGAGCTGTGCGTGCGGGGCCGATGATCATGAGCGGCTACGTGAACAACCC
GGAGGCCACCAACGCCCTCATCGACAAGGACGGCTGGCTGCACAGCGGCGACATCGCCTA
CTGGGACGAGGACGAGCACTTCTTCATCGTCGACCGGCTGAAGTCGCTGATCAAGTACAA
GGGCTACCAGGTGGCGCCGGCCGAGCTGGAGAGCATCCTGCTCCAGCACCCCAACATCTT
CGACGCCGGCGTGGCCGGGCTGCCGGACGACGACGCCGGCGAGCTGCCGGCCGCGGTGGT
GGTGCTGGAGCACGGCAAGACCATGACGGAGAAGGAGATCGTCGACTACGTGGCCAGCCA
GGTGACCACCGCCAAGAAGCTGCGGGGCGGCGTGGTGTTCGTGGACGAGGTCCCGAAGGG
CCTGACCGGGAAGCTCGACGCCCGGAAGATCCGCGAGATCCTGATCAAGGCCAAGAAGGG
CGGCAAGATCGCCGTGTAAGACTAGTTATAAGACTGACTAGCCCGATGGGCCTCCCAACG
GGCCCTCCTCCCCTCCTTGCACCGAGATTAATAAAAAAAAAAAAAAAAAAAAAAAAAAAA
AAAAAAAAAAAAAAAAAAAAAAAAAAAAAAAAAA
```

Figure 22 nucleotide sequence of rpl21 – PpLuc(GC) – ag – A64

GGGGCCGGAACCGCCATCTTCCAGTAATTCGCCAAAAAGCTTGAGGATGGAGGACGCCAA
GAACATCAAGAAGGGCCCGGCGCCCTTCTACCCGCTGGAGGACGGGACCGCCGGCGAGCA
GCTCCACAAGGCCATGAAGCGGTACGCCCTGGTGCCGGGCACGATCGCCTTCACCGACGC
CCACATCGAGGTCGACATCACCTACGCGGAGTACTTCGAGATGAGCGTGCGCCTGGCCGA
GGCCATGAAGCGGTACGGCCTGAACACCAACCACCGGATCGTGGTGTGCTCGGAGAACAG
CCTGCAGTTCTTCATGCCGGTGCTGGGCGCCCTCTTCATCGGCGTGGCCGTCGCCCCGGC
GAACGACATCTACAACGAGCGGGAGCTGCTGAACAGCATGGGGATCAGCCAGCCGACCGT
GGTGTTCGTGAGCAAGAAGGGCCTGCAGAAGATCCTGAACGTGCAGAAGAAGCTGCCCAT
CATCCAGAAGATCATCATCATGGACAGCAAGACCGACTACCAGGGCTTCCAGTCGATGTA
CACGTTCGTGACCAGCCACCTCCCGCCGGGCTTCAACGAGTACGACTTCGTCCCGGAGAG
CTTCGACCGGGACAAGACCATCGCCCTGATCATGAACAGCAGCGGCAGCACCGGCCTGCC
GAAGGGGGTGGCCCTGCCGCACCGGACCGCCTGCGTGCGCTTCTCGCACGCCCGGGACCC
CATCTTCGGCAACCAGATCATCCCGGACACCGCCATCCTGAGCGTGGTGCCGTTCCACCA
CGGCTTCGGCATGTTCACGACCCTGGGCTACCTCATCTGCGGCTTCCGGGTGGTCCTGAT
GTACCGGTTCGAGGAGGAGCTGTTCCTGCGGAGCCTGCAGGACTACAAGATCCAGAGCGC
GCTGCTCGTGCCGACCCTGTTCAGCTTCTTCGCCAAGAGCACCCTGATCGACAAGTACGA
CCTGTCGAACCTGCACGAGATCGCCAGCGGGGCGCCCCGCTGAGCAAGGAGGTGGGCGA
GGCCGTGGCCAAGCGGTTCCACCTCCCGGGCATCCGCCAGGGCTACGGCCTGACCGAGAC
CACGAGCGCGATCCTGATCACCCCCGAGGGGACGACAAGCCGGGCGCCGTGGGCAAGGT
GGTCCCGTTCTTCGAGGCCAAGGTGGTGGACCTGGACACCGGCAAGACCCTGGGCGTGAA
CCAGCGGGGCGAGCTGTGCGTGCGGGGCCGATGATCATGAGCGGCTACGTGAACAACCC
GGAGGCCACCAACGCCCTCATCGACAAGGACGGCTGGCTGCACAGCGGCGACATCGCCTA
CTGGGACGAGGACGAGCACTTCTTCATCGTCGACCGGCTGAAGTCGCTGATCAAGTACAA
GGGCTACCAGGTGGCGCCGGCCGAGCTGGAGAGCATCCTGCTCCAGCACCCCAACATCTT
CGACGCCGGCGTGGCCGGGCTGCCGGACGACGACGCCGGCGAGCTGCCGGCCGCGGTGGT
GGTGCTGGAGCACGGCAAGACCATGACGGAGAAGGAGATCGTCGACTACGTGGCCAGCCA
GGTGACCACCGCCAAGAAGCTGCGGGGCGGCGTGGTGTTCGTGGACGAGGTCCCGAAGGG
CCTGACCGGGAAGCTCGACGCCCGGAAGATCCGCGAGATCCTGATCAAGGCAAGAAGGG
CGGCAAGATCGCCGTGTAAGACTAGTTATAAGACTGACTAGCCCGATGGGCCTCCCAACG
GGCCCTCCTCCCCTCCTTGCACCGAGATTAATAAAAAAAAAAAAAAAAAAAAAAAAAAAA
AAAAAAAAAAAAAAAAAAAAAAAAAAAAAAAA

Figure 23 nucleotide sequence of atp5a1 – PpLuc(GC) – ag – A64

GGGCGGCTCGGCCATTTTGTCCCAGTCAGTCCGGAGGCTGCGGCTGCAGAAGTACCGCCT
GCGGAGTAACTGCAAAGAAGCTTGAGGATGGAGGACGCCAAGAACATCAAGAAGGGCCCG
GCGCCCTTCTACCCGCTGGAGGACGGGACCGCCGGCGAGCAGCTCCACAAGGCCATGAAG
CGGTACGCCCTGGTGCCGGGCACGATCGCCTTCACCGACGCCCACATCGAGGTCGACATC
ACCTACGCGGAGTACTTCGAGATGAGCGTGCGCCTGGCCGAGGCCATGAAGCGGTACGGC
CTGAACACCAACCACCGGATCGTGGTGTGCTCGGAGAACAGCCTGCAGTTCTTCATGCCG
GTGCTGGGCGCCCTCTTCATCGGCGTGGCCGTCGCCCCGGCAACGACATCTACAACGAG
CGGGAGCTGCTGAACAGCATGGGGATCAGCCAGCCGACCGTGGTGTTCGTGAGCAAGAAG
GGCCTGCAGAAGATCCTGAACGTGCAGAAGAAGCTGCCCATCATCCAGAAGATCATCATC
ATGGACAGCAAGACCGACTACCAGGGCTTCCAGTCGATGTACACGTTCGTGACCAGCCAC
CTCCCGCCGGGCTTCAACGAGTACGACTTCGTCCCGGAGAGCTTCGACCGGGACAAGACC
ATCGCCCTGATCATGAACAGCAGCGGCAGCACCGGCCTGCCGAAGGGGGTGGCCCTGCCG
CACCGGACCGCCTGCGTGCGCTTCTCGCACGCCCGGGACCCCATCTTCGGCAACCAGATC
ATCCCGGACACCGCCATCCTGAGCGTGGTGCCGTTCCACCACGGCTTCGGCATGTTCACG
ACCCTGGGCTACCTCATCTGCGGCTTCCGGGTGGTCCTGATGTACCGGTTCGAGGAGGAG
CTGTTCCTGCGGAGCCTGCAGGACTACAAGATCCAGAGCGCGCTGCTCGTGCCGACCCTG
TTCAGCTTCTTCGCCAAGAGCACCCTGATCGACAAGTACGACCTGTCGAACCTGCACGAG
ATCGCCAGCGGGGGCGCCCCGCTGAGCAAGGAGGTGGGCGAGGCCGTGGCCAAGCGGTTC
CACCTCCCGGGCATCCGCCAGGGCTACGGCCTGACCGAGACCACGAGCGCGATCCTGATC
ACCCCCGAGGGGACGACAAGCCGGGCGCCGTGGGCAAGGTGGTCCCGTTCTTCGAGGCC
AAGGTGGTGGACCTGGACACCGGCAAGACCCTGGGCGTGAACCAGCGGGGCGAGCTGTGC
GTGCGGGGGCCGATGATCATGAGCGGCTACGTGAACAACCCGGAGGCCACCAACGCCCTC
ATCGACAAGGACGGCTGGCTGCACAGCGGCGACATCGCCTACTGGGACGAGGACGAGCAC
TTCTTCATCGTCGACCGGCTGAAGTCGCTGATCAAGTACAAGGGCTACCAGGTGGCGCCG
GCCGAGCTGGAGAGCATCCTGCTCCAGCACCCCAACATCTTCGACGCCGGCGTGGCCGGG
CTGCCGGACGACGACGCCGGCGAGCTGCCGGCCGCGGTGGTGGTGCTGGAGCACGGCAAG
ACCATGACGGAGAAGGAGATCGTCGACTACGTGGCCAGCCAGGTGACCACCGCCAAGAAG
CTGCGGGGCGGCGTGGTGTTCGTGGACGAGGTCCCGAAGGGCCTGACCGGGAAGCTCGAC
GCCCGGAAGATCCGCGAGATCCTGATCAAGGCCAAGAAGGGCGGCAAGATCGCCGTGTAA
GACTAGTTATAAGACTGACTAGCCCGATGGGCCTCCCAACGGGCCCTCCTCCCCTCCTTG
CACCGAGATTAATAAAAAAAAAAAAAAAAAAAAAAAAAAAAAAAAAAAAAAAAAAAAAAA
AAAAAAAAAAAAAAAA

Figure 24 nucleotide sequence of HSD17B4 – PpLuc(GC) – ag – A64

GGGTCCCGCAGTCGGCGTCCAGCGGCTCTGCTTGTTCGTGTGTGTGTCGTTGCAGGCCTT
ATTCAAGCTTGAGGATGGAGGACGCCAAGAACATCAAGAAGGGCCCGGCGCCCTTCTACC
CGCTGGAGGACGGGACCGCCGGCGAGCAGCTCCACAAGGCCATGAAGCGGTACGCCCTGG
TGCCGGGCACGATCGCCTTCACCGACGCCCACATCGAGGTCGACATCACCTACGCGGAGT
ACTTCGAGATGAGCGTGCGCCTGGCCGAGGCCATGAAGCGGTACGGCCTGAACACCAACC
ACCGGATCGTGGTGTGCTCGGAGAACAGCCTGCAGTTCTTCATGCCGGTGCTGGGCGCCC
TCTTCATCGGCGTGGCCGTCGCCCCGGCGAACGACATCTACAACGAGCGGGAGCTGCTGA
ACAGCATGGGGATCAGCCAGCCGACCGTGGTGTTCGTGAGCAAGAAGGGCCTGCAGAAGA
TCCTGAACGTGCAGAAGAAGCTGCCCATCATCCAGAAGATCATCATCATGGACAGCAAGA
CCGACTACCAGGGCTTCCAGTCGATGTACACGTTCGTGACCAGCCACCTCCCGCCGGGCT
TCAACGAGTACGACTTCGTCCCGGAGAGCTTCGACCGGGACAAGACCATCGCCCTGATCA
TGAACAGCAGCGGCAGCACCGGCCTGCCGAAGGGGGTGGCCCTGCCGCACCGGACCGCCT
GCGTGCGCTTCTCGCACGCCCGGGACCCCATCTTCGGCAACCAGATCATCCCGGACACCG
CCATCCTGAGCGTGGTGCCGTTCCACCACGGCTTCGGCATGTTCACGACCCTGGGCTACC
TCATCTGCGGCTTCCGGGTGGTCCTGATGTACCGGTTCGAGGAGGAGCTGTTCCTGCGGA
GCCTGCAGGACTACAAGATCCAGAGCGCGCTGCTCGTGCCGACCCTGTTCAGCTTCTTCG
CCAAGAGCACCCTGATCGACAAGTACGACCTGTCGAACCTGCACGAGATCGCCAGCGGGG
GCGCCCCGCTGAGCAAGGAGGTGGGCGAGGCCGTGGCCAAGCGGTTCCACCTCCCGGGCA
TCCGCCAGGGCTACGGCCTGACCGAGACCACGAGCGCGATCCTGATCACCCCCGAGGGGG
ACGACAAGCCGGGCGCCGTGGGCAAGGTGGTCCCGTTCTTCGAGGCCAAGGTGGTGGACC
TGGACACCGGCAAGACCCTGGGCGTGAACCAGCGGGGCGAGCTGTGCGTGCGGGGGCCGA
TGATCATGAGCGGCTACGTGAACAACCCGGAGGCCACCAACGCCCTCATCGACAAGGACG
GCTGGCTGCACAGCGGCGACATCGCCTACTGGGACGAGGACGAGCACTTCTTCATCGTCG
ACCGGCTGAAGTCGCTGATCAAGTACAAGGGCTACCAGGTGGCGCCGGCCGAGCTGGAGA
GCATCCTGCTCCAGCACCCCAACATCTTCGACGCCGGCGTGGCCGGGCTGCCGGACGACG
ACGCCGGCGAGCTGCCGGCCGCGGTGGTGGTGCTGGAGCACGGCAAGACCATGACGGAGA
AGGAGATCGTCGACTACGTGGCCAGCCAGGTGACCACCGCCAAGAAGCTGCGGGGCGGCG
TGGTGTTCGTGGACGAGGTCCCGAAGGGCCTGACCGGGAAGCTCGACGCCCGGAAGATCC
GCGAGATCCTGATCAAGGCCAAGAAGGGCGGCAAGATCGCCGTGTAAGACTAGTTATAAG
ACTGACTAGCCCGATGGGCCTCCCAACGGGCCCTCCTCCCCTCCTTGCACCGAGATTAAT
AAAAAAAAAAAAAAAAAAAAAAAAAAAAAAAAAAAAAAAAAAAAAAAAAAAAAAAAAAAA
AAAA

Figure 25 nucleotide sequence of AIG1 – PpLuc(GC) – ag – A64

GGGCCGCCCAGCCGGTCCAGGCCTCTGGCGAACAAGCTTGAGGATGGAGGACGCCAAGAA
CATCAAGAAGGGCCCGGCGCCCTTCTACCCGCTGGAGGACGGGACCGCCGGCGAGCAGCT
CCACAAGGCCATGAAGCGGTACGCCCTGGTGCCGGGCACGATCGCCTTCACCGACGCCCA
CATCGAGGTCGACATCACCTACGCGGAGTACTTCGAGATGAGCGTGCGCCTGGCCGAGGC
CATGAAGCGGTACGGCCTGAACACCAACCACCGGATCGTGGTGTGCTCGGAGAACAGCCT
GCAGTTCTTCATGCCGGTGCTGGGCGCCCTCTTCATCGGCGTGGCCGTCGCCCCGGCGAA
CGACATCTACAACGAGCGGGAGCTGCTGAACAGCATGGGGATCAGCCAGCCGACCGTGGT
GTTCGTGAGCAAGAAGGGCCTGCAGAAGATCCTGAACGTGCAGAAGAAGCTGCCCATCAT
CCAGAAGATCATCATCATGGACAGCAAGACCGACTACCAGGGCTTCCAGTCGATGTACAC
GTTCGTGACCAGCCACCTCCCGCCGGGCTTCAACGAGTACGACTTCGTCCCGGAGAGCTT
CGACCGGGACAAGACCATCGCCCTGATCATGAACAGCAGCGGCAGCACCGGCCTGCCGAA
GGGGGTGGCCCTGCCGCACCGGACCGCCTGCGTGCGCTTCTCGCACGCCCGGGACCCCAT
CTTCGGCAACCAGATCATCCCGGACACCGCCATCCTGAGCGTGGTGCCGTTCCACCACGG
CTTCGGCATGTTCACGACCCTGGGCTACCTCATCTGCGGCTTCCGGGTGGTCCTGATGTA
CCGGTTCGAGGAGGAGCTGTTCCTGCGGAGCCTGCAGGACTACAAGATCCAGAGCGCGCT
GCTCGTGCCGACCCTGTTCAGCTTCTTCGCCAAGAGCACCCTGATCGACAAGTACGACCT
GTCGAACCTGCACGAGATCGCCAGCGGGGGCGCCCCGCTGAGCAAGGAGGTGGGCGAGGC
CGTGGCCAAGCGGTTCCACCTCCCGGGCATCCGCCAGGGCTACGGCCTGACCGAGACCAC
GAGCGCGATCCTGATCACCCCCGAGGGGGACGACAAGCCGGGCGCCGTGGGCAAGGTGGT
CCCGTTCTTCGAGGCCAAGGTGGTGGACCTGGACACCGGCAAGACCCTGGGCGTGAACCA
GCGGGGCGAGCTGTGCGTGCGGGGCCGATGATCATGAGCGGCTACGTGAACAACCCGGA
GGCCACCAACGCCCTCATCGACAAGGACGGCTGGCTGCACAGCGGCGACATCGCCTACTG
GGACGAGGACGAGCACTTCTTCATCGTCGACCGGCTGAAGTCGCTGATCAAGTACAAGGG
CTACCAGGTGGCGCCGGCCGAGCTGGAGAGCATCCTGCTCCAGCACCCCAACATCTTCGA
CGCCGGCGTGGCCGGGCTGCCGGACGACGACGCCGGCGAGCTGCCGGCCGCGGTGGTGGT
GCTGGAGCACGGCAAGACCATGACGGAGAAGGAGATCGTCGACTACGTGGCCAGCCAGGT
GACCACCGCCAAGAAGCTGCGGGGCGGCGTGGTGTTCGTGGACGAGGTCCCGAAGGGCCT
GACCGGGAAGCTCGACGCCCGGAAGATCCGCGAGATCCTGATCAAGGCCAAGAAGGGCGG
CAAGATCGCCGTGTAAGACTAGTTATAAGACTGACTAGCCCGATGGGCCTCCCAACGGGC
CCTCCTCCCCTCCTTGCACCGAGATTAATAAAAAAAAAAAAAAAAAAAAAAAAAAAAAAA
AAAAAAAAAAAAAAAAAAAAAAAAAAAAAA

Figure 26 nucleotide sequence of COX6C – PpLuc(GC) – ag – A64

```
GGAGTCAGGAAGGACGTTGGTGTTGAGGTTAGCATACGTATCAAGGACAGTAACTACCAA
GCTTGAGGATGGAGGACGCCAAGAACATCAAGAAGGGCCCGGCGCCCTTCTACCCGCTGG
AGGACGGGACCGCCGGCGAGCAGCTCCACAAGGCCATGAAGCGGTACGCCCTGGTGCCGG
GCACGATCGCCTTCACCGACGCCCACATCGAGGTCGACATCACCTACGCGGAGTACTTCG
AGATGAGCGTGCGCCTGGCCGAGGCCATGAAGCGGTACGGCCTGAACACCAACCACCGGA
TCGTGGTGTGCTCGGAGAACAGCCTGCAGTTCTTCATGCCGGTGCTGGGCGCCCTCTTCA
TCGGCGTGGCCGTCGCCCCGGCGAACGACATCTACAACGAGCGGGAGCTGCTGAACAGCA
TGGGGATCAGCCAGCCGACCGTGGTGTTCGTGAGCAAGAAGGGCCTGCAGAAGATCCTGA
ACGTGCAGAAGAAGCTGCCCATCATCCAGAAGATCATCATCATGGACAGCAAGACCGACT
ACCAGGGCTTCCAGTCGATGTACACGTTCGTGACCAGCCACCTCCCGCCGGGCTTCAACG
AGTACGACTTCGTCCCGGAGAGCTTCGACCGGGACAAGACCATCGCCCTGATCATGAACA
GCAGCGGCAGCACCGGCCTGCCGAAGGGGGTGGCCCTGCCGCACCGGACCGCCTGCGTGC
GCTTCTCGCACGCCCGGGACCCCATCTTCGGCAACCAGATCATCCCGGACACCGCCATCC
TGAGCGTGGTGCCGTTCCACCACGGCTTCGGCATGTTCACGACCCTGGGCTACCTCATCT
GCGGCTTCCGGGTGGTCCTGATGTACCGGTTCGAGGAGGAGCTGTTCCTGCGGAGCCTGC
AGGACTACAAGATCCAGAGCGCGCTGCTCGTGCCGACCCTGTTCAGCTTCTTCGCCAAGA
GCACCCTGATCGACAAGTACGACCTGTCGAACCTGCACGAGATCGCCAGCGGGGCGCCC
CGCTGAGCAAGGAGGTGGGCGAGGCCGTGGCCAAGCGGTTCCACCTCCCGGGCATCCGCC
AGGGCTACGGCCTGACCGAGACCACGAGCGCGATCCTGATCACCCCCGAGGGGACGACA
AGCCGGGCGCCGTGGGCAAGGTGGTCCCGTTCTTCGAGGCCAAGGTGGTGGACCTGGACA
CCGGCAAGACCCTGGGCGTGAACCAGCGGGCGAGCTGTGCGTGCGGGGCCGATGATCA
TGAGCGGCTACGTGAACAACCCGGAGGCCACCAACGCCCTCATCGACAAGGACGGCTGGC
TGCACAGCGGCGACATCGCCTACTGGGACGAGGACGAGCACTTCTTCATCGTCGACCGGC
TGAAGTCGCTGATCAAGTACAAGGGCTACCAGGTGGCGCCGGCCGAGCTGGAGAGCATCC
TGCTCCAGCACCCCAACATCTTCGACGCCGGCGTGGCCGGGCTGCCGGACGACGACGCCG
GCGAGCTGCCGGCCGCGGTGGTGGTGCTGGAGCACGGCAAGACCATGACGGAGAAGGAGA
TCGTCGACTACGTGGCCAGCCAGGTGACCACCGCCAAGAAGCTGCGGGGCGGCGTGGTGT
TCGTGGACGAGGTCCCGAAGGGCCTGACCGGGAAGCTCGACGCCCGGAAGATCCGCGAGA
TCCTGATCAAGGCCAAGAAGGGCGGCAAGATCGCCGTGTAAGACTAGTTATAAGACTGAC
TAGCCCGATGGGCCTCCCAACGGGCCCTCCTCCCCTCCTTGCACCGAGATTAATAAAAAA
AAAAAAAAAAAAAAAAAAAAAAAAAAAAAAAAAAAAAAAAAAAAAAAAAAAAAAAAAAA
```

Figure 27 nucleotide sequence of ASAH1 – PpLuc(GC) – ag – A64

GGGCCTCTGCTGGAGTCCGGGGAGTGGCGTTGGCTGCTAGAGCGAAGCTTGAGGATGGAG
GACGCCAAGAACATCAAGAAGGGCCCGGCGCCCTTCTACCCGCTGGAGGACGGGACCGCC
GGCGAGCAGCTCCACAAGGCCATGAAGCGGTACGCCCTGGTGCCGGGCACGATCGCCTTC
ACCGACGCCCACATCGAGGTCGACATCACCTACGCGGAGTACTTCGAGATGAGCGTGCGC
CTGGCCGAGGCCATGAAGCGGTACGGCCTGAACACCAACCACCGGATCGTGGTGTGCTCG
GAGAACAGCCTGCAGTTCTTCATGCCGGTGCTGGGCGCCCTCTTCATCGGCGTGGCCGTC
GCCCCGGCGAACGACATCTACAACGAGCGGGAGCTGCTGAACAGCATGGGGATCAGCCAG
CCGACCGTGGTGTTCGTGAGCAAGAAGGGCCTGCAGAAGATCCTGAACGTGCAGAAGAAG
CTGCCCATCATCCAGAAGATCATCATCATGGACAGCAAGACCGACTACCAGGGCTTCCAG
TCGATGTACACGTTCGTGACCAGCCACCTCCCGCCGGGCTTCAACGAGTACGACTTCGTC
CCGGAGAGCTTCGACCGGGACAAGACCATCGCCCTGATCATGAACAGCAGCGGCAGCACC
GGCCTGCCGAAGGGGGTGGCCCTGCCGCACCGGACCGCCTGCGTGCGCTTCTCGCACGCC
CGGGACCCCATCTTCGGCAACCAGATCATCCCGGACACCGCCATCCTGAGCGTGGTGCCG
TTCCACCACGGCTTCGGCATGTTCACGACCCTGGGCTACCTCATCTGCGGCTTCCGGGTG
GTCCTGATGTACCGGTTCGAGGAGGAGCTGTTCCTGCGGAGCCTGCAGGACTACAAGATC
CAGAGCGCGCTGCTCGTGCCGACCCTGTTCAGCTTCTTCGCCAAGAGCACCCTGATCGAC
AAGTACGACCTGTCGAACCTGCACGAGATCGCCAGCGGGGGCGCCCCGCTGAGCAAGGAG
GTGGGCGAGGCCGTGGCCAAGCGGTTCCACCTCCCGGGCATCCGCCAGGGCTACGGCCTG
ACCGAGACCACGAGCGCGATCCTGATCACCCCCGAGGGGGACGACAAGCCGGGCGCCGTG
GGCAAGGTGGTCCCGTTCTTCGAGGCCAAGGTGGTGGACCTGGACACCGGCAAGACCCTG
GGCGTGAACCAGCGGGGCGAGCTGTGCGTGCGGGGCCCGATGATCATGAGCGGCTACGTG
AACAACCCGGAGGCCACCAACGCCCTCATCGACAAGGACGGCTGGCTGCACAGCGGCGAC
ATCGCCTACTGGGACGAGGACGAGCACTTCTTCATCGTCGACCGGCTGAAGTCGCTGATC
AAGTACAAGGGCTACCAGGTGGCGCCGGCCGAGCTGGAGAGCATCCTGCTCCAGCACCCC
AACATCTTCGACGCCGGCGTGGCCGGGCTGCCGGACGACGACGCCGGCGAGCTGCCGGCC
GCGGTGGTGGTGCTGGAGCACGGCAAGACCATGACGGAGAAGGAGATCGTCGACTACGTG
GCCAGCCAGGTGACCACCGCCAAGAAGCTGCGGGGCGGCGTGGTGTTCGTGGACGAGGTC
CCGAAGGGCCTGACCGGGAAGCTCGACGCCCGGAAGATCCGCGAGATCCTGATCAAGGCC
AAGAAGGGCGGCAAGATCGCCGTGTAAGACTAGTTATAAGACTGACTAGCCCGATGGGCC
TCCCAACGGGCCCTCCTCCCTCCTTGCACCGAGATTAATAAAAAAAAAAAAAAAAAAAAA
AAAAAAAAAAAAAAAAAAAAAAAAAAAAAAAAAAAAAAAAAAA

Figure 28 nucleotide sequence of RPL35 – PpLuc(GC) – ag – A64 – histoneSL

<u>GGGGAGCGGGCGGCGGCGTTGGCGGCTTGTGCAGCAAAGCTTGAGG</u>*ATGGAGGACGCCAA*
*GAACATCAAGAAGGGCCCGGCGCCCTTCTACCCGCTGGAGGACGGGACCGCCGGCGAGCA*
*GCTCCACAAGGCCATGAAGCGGTACGCCCTGGTGCCGGGCACGATCGCCTTCACCGACGC*
*CCACATCGAGGTCGACATCACCTACGCGGAGTACTTCGAGATGAGCGTGCGCCTGGCCGA*
*GGCCATGAAGCGGTACGGCCTGAACACCAACCACCGGATCGTGGTGTGCTCGGAGAACAG*
*CCTGCAGTTCTTCATGCCGGTGCTGGGCGCCCTCTTCATCGGCGTGGCCGTCGCCCCGGC*
*GAACGACATCTACAACGAGCGGGAGCTGCTGAACAGCATGGGGATCAGCCAGCCGACCGT*
*GGTGTTCGTGAGCAAGAAGGGCCTGCAGAAGATCCTGAACGTGCAGAAGAAGCTGCCCAT*
*CATCCAGAAGATCATCATCATGGACAGCAAGACCGACTACCAGGGCTTCCAGTCGATGTA*
*CACGTTCGTGACCAGCCACCTCCCGCCGGGCTTCAACGAGTACGACTTCGTCCCGGAGAG*
*CTTCGACCGGGACAAGACCATCGCCCTGATCATGAACAGCAGCGGCAGCACCGGCCTGCC*
*GAAGGGGGTGGCCCTGCCGCACCGGACCGCCTGCGTGCGCTTCTCGCACGCCCGGGACCC*
*CATCTTCGGCAACCAGATCATCCCGGACACCGCCATCCTGAGCGTGGTGCCGTTCCACCA*
*CGGCTTCGGCATGTTCACGACCCTGGGCTACCTCATCTGCGGCTTCCGGGTGGTCCTGAT*
*GTACCGGTTCGAGGAGGAGCTGTTCCTGCGGAGCCTGCAGGACTACAAGATCCAGAGCGC*
*GCTGCTCGTGCCGACCCTGTTCAGCTTCTTCGCCAAGAGCACCCTGATCGACAAGTACGA*
*CCTGTCGAACCTGCACGAGATCGCCAGCGGGGCGCCCCGCTGAGCAAGGAGGTGGGCGA*
*GGCCGTGGCCAAGCGGTTCCACCTCCCGGGCATCCGCCAGGGCTACGGCCTGACCGAGAC*
*CACGAGCGCGATCCTGATCACCCCCGAGGGGACGACAAGCCGGGCGCCGTGGGCAAGGT*
*GGTCCCGTTCTTCGAGGCCAAGGTGGTGGACCTGGACACCGGCAAGACCCTGGGCGTGAA*
*CCAGCGGGGCGAGCTGTGCGTGCGGGGCCGATGATCATGAGCGGCTACGTGAACAACCC*
*GGAGGCCACCAACGCCCTCATCGACAAGGACGGCTGGCTGCACAGCGGCGACATCGCCTA*
*CTGGGACGAGGACGAGCACTTCTTCATCGTCGACCGGCTGAAGTCGCTGATCAAGTACAA*
*GGGCTACCAGGTGGCGCCGGCCGAGCTGGAGAGCATCCTGCTCCAGCACCCCAACATCTT*
*CGACGCCGGCGTGGCCGGGCTGCCGGACGACGACGCCGGCGAGCTGCCGGCCGCGGTGGT*
*GGTGCTGGAGCACGGCAAGACCATGACGGAGAAGGAGATCGTCGACTACGTGGCCAGCCA*
*GGTGACCACCGCCAAGAAGCTGCGGGGCGGCGTGGTGTTCGTGGACGAGGTCCCGAAGGG*
*CCTGACCGGGAAGCTCGACGCCCGGAAGATCCGCGAGATCCTGATCAAGGCCAAGAAGGG*
*CGGCAAGATCGCCGTGTAAGACTAGTTATAAGACTGACTAGCCCGATGGGCCTCCCAACG*
*GGCCCTCCTCCCCTCCTTGCACCGAGATTAATAAAAAAAAAAAAAAAAAAAAAAAAAAAAA*
*AAAAAAAAAAAAAAAAAAAAAAAAAAAAAAAAAAAATGCAT*<u>CAAAGGCTCTTTTCAGAGC</u>
<u>CACCA</u>

Figure 29 nucleotide sequence of rpl21 – PpLuc(GC) – ag – A64 – histoneSL

GGGGCCGGAACCGCCATCTTCCAGTAATTCGCCAAAAAGCTTGAGGATGGAGGACGCCAA
GAACATCAAGAAGGGCCCGGCGCCCTTCTACCCGCTGGAGGACGGGACCGCCGGCGAGCA
GCTCCACAAGGCCATGAAGCGGTACGCCCTGGTGCCGGGCACGATCGCCTTCACCGACGC
CCACATCGAGGTCGACATCACCTACGCGGAGTACTTCGAGATGAGCGTGCGCCTGGCCGA
GGCCATGAAGCGGTACGGCCTGAACACCAACCACCGGATCGTGGTGTGCTCGGAGAACAG
CCTGCAGTTCTTCATGCCGGTGCTGGGCGCCCTCTTCATCGGCGTGGCCGTCGCCCCGGC
GAACGACATCTACAACGAGCGGGAGCTGCTGAACAGCATGGGGATCAGCCAGCCGACCGT
GGTGTTCGTGAGCAAGAAGGGCCTGCAGAAGATCCTGAACGTGCAGAAGAAGCTGCCCAT
CATCCAGAAGATCATCATCATGGACAGCAAGACCGACTACCAGGGCTTCCAGTCGATGTA
CACGTTCGTGACCAGCCACCTCCCGCCGGGCTTCAACGAGTACGACTTCGTCCCGGAGAG
CTTCGACCGGGACAAGACCATCGCCCTGATCATGAACAGCAGCGGCAGCACCGGCCTGCC
GAAGGGGGTGGCCCTGCCGCACCGGACCGCCTGCGTGCGCTTCTCGCACGCCCGGGACCC
CATCTTCGGCAACCAGATCATCCCGGACACCGCCATCCTGAGCGTGGTGCCGTTCCACCA
CGGCTTCGGCATGTTCACGACCCTGGGCTACCTCATCTGCGGCTTCCGGGTGGTCCTGAT
GTACCGGTTCGAGGAGGAGCTGTTCCTGCGGAGCCTGCAGGACTACAAGATCCAGAGCGC
GCTGCTCGTGCCGACCCTGTTCAGCTTCTTCGCCAAGAGCACCCTGATCGACAAGTACGA
CCTGTCGAACCTGCACGAGATCGCCAGCGGGGGCGCCCCGCTGAGCAAGGAGGTGGGCGA
GGCCGTGGCCAAGCGGTTCCACCTCCCGGGCATCCGCCAGGGCTACGGCCTGACCGAGAC
CACGAGCGCGATCCTGATCACCCCCGAGGGGGACGACAAGCCGGGCGCCGTGGGCAAGGT
GGTCCCGTTCTTCGAGGCCAAGGTGGTGGACCTGGACACCGGCAAGACCCTGGGCGTGAA
CCAGCGGGGCGAGCTGTGCGTGCGGGGGCCGATGATCATGAGCGGCTACGTGAACAACCC
GGAGGCCACCAACGCCCTCATCGACAAGGACGGCTGGCTGCACAGCGGCGACATCGCCTA
CTGGGACGAGGACGAGCACTTCTTCATCGTCGACCGGCTGAAGTCGCTGATCAAGTACAA
GGGCTACCAGGTGGCGCCGGCCGAGCTGGAGAGCATCCTGCTCCAGCACCCCAACATCTT
CGACGCCGGCGTGGCCGGGCTGCCGGACGACGACGCCGGCGAGCTGCCGGCCGCGGTGGT
GGTGCTGGAGCACGGCAAGACCATGACGGAGAAGGAGATCGTCGACTACGTGGCCAGCCA
GGTGACCACCGCCAAGAAGCTGCGGGGCGGCGTGGTGTTCGTGGACGAGGTCCCGAAGGG
CCTGACCGGGAAGCTCGACGCCCGGAAGATCCGCGAGATCCTGATCAAGGCCAAGAAGGG
CGGCAAGATCGCCGTGTAAGACTAGTTATAAGACTGACTAGCCCGATGGGCCTCCCAACG
GCCCTCCTCCCCTCCTTGCACCGAGATTAATAAAAAAAAAAAAAAAAAAAAAAAAAAAAA
AAAAAAAAAAAAAAAAAAAAAAAAAAAAAAAAAAATGCATCAAAGGCTCTTTTCAGAGC
CACCA nucleotide sequence of atp5a1 – PpLuc(GC) – ag – A64 – histoneSL GGGCGGCTCGGCCATTTTGTCCCAGTCAGTCCGGAGGCTGCGGCTGCAGAAGTACCGCCT
GCGGAGTAACTGCAAAGAAGCTTGAGGATGGAGGACGCCAAGAACATCAAGAAGGGCCCG
GCGCCCTTCTACCCGCTGGAGGACGGGACCGCCGGCGAGCAGCTCCACAAGGCCATGAAG
CGGTACGCCCTGGTGCCGGGCACGATCGCCTTCACCGACGCCCACATCGAGGTCGACATC
ACCTACGCGGAGTACTTCGAGATGAGCGTGCGCCTGGCCGAGGCCATGAAGCGGTACGGC
CTGAACACCAACCACCGGATCGTGGTGTGCTCGGAGAACAGCCTGCAGTTCTTCATGCCG
GTGCTGGGCGCCCTCTTCATCGGCGTGGCCGTCGCCCCGGCAACGACATCTACAACGAG
CGGGAGCTGCTGAACAGCATGGGGATCAGCCAGCCGACCGTGGTGTTCGTGAGCAAGAAG
GGCCTGCAGAAGATCCTGAACGTGCAGAAGAAGCTGCCCATCATCCAGAAGATCATCATC
ATGGACAGCAAGACCGACTACCAGGGCTTCCAGTCGATGTACACGTTCGTGACCAGCCAC
CTCCCGCCGGGCTTCAACGAGTACGACTTCGTCCCGGAGAGCTTCGACCGGGACAAGACC
ATCGCCCTGATCATGAACAGCAGCGGCAGCACCGGCCTGCCGAAGGGGGTGGCCCTGCCG
CACCGGACCGCCTGCGTGCGCTTCTCGCACGCCCGGGACCCCATCTTCGGCAACCAGATC
ATCCCGGACACCGCCATCCTGAGCGTGGTGCCGTTCCACCACGGCTTCGGCATGTTCACG
ACCCTGGGCTACCTCATCTGCGGCTTCCGGGTGGTCCTGATGTACCGGTTCGAGGAGGAG
CTGTTCCTGCGGAGCCTGCAGGACTACAAGATCCAGAGCGCGCTGCTCGTGCCGACCCTG
TTCAGCTTCTTCGCCAAGAGCACCCTGATCGACAAGTACGACCTGTCGAACCTGCACGAG
ATCGCCAGCGGGGCGCCCCGCTGAGCAAGGAGGTGGGCGAGGCCGTGGCCAAGCGGTTC
CACCTCCCGGGCATCCGCCAGGGCTACGGCCTGACCGAGACCACGAGCGCGATCCTGATC
ACCCCCGAGGGGGACGACAAGCCGGGCGCCGTGGGCAAGGTGGTCCCGTTCTTCGAGGCC
AAGGTGGTGGACCTGGACACCGGCAAGACCCTGGGCGTGAACCAGCGGGGCGAGCTGTGC
GTGCGGGGGCCGATGATCATGAGCGGCTACGTGAACAACCCGGAGGCCACCAACGCCCTC
ATCGACAAGGACGGCTGGCTGCACAGCGGCGACATCGCCTACTGGGACGAGGACGAGCAC
TTCTTCATCGTCGACCGGCTGAAGTCGCTGATCAAGTACAAGGGCTACCAGGTGGCGCCG
GCCGAGCTGGAGAGCATCCTGCTCCAGCACCCCAACATCTTCGACGCCGGCGTGGCCGGG
CTGCCGGACGACGACGCCGGCGAGCTGCCGGCCGCGGTGGTGGTGCTGGAGCACGGCAAG
ACCATGACGGAGAAGGAGATCGTCGACTACGTGGCCAGCCAGGTGACCACCGCCAAGAAG
CTGCGGGGCGGCGTGGTGTTCGTGGACGAGGTCCCGAAGGGCCTGACCGGGAAGCTCGAC
GCCCGGAAGATCCGCGAGATCCTGATCAAGGCCAAGAAGGGCGGCAAGATCGCCGTGTAA
GACTAGTTATAAGACTGACTAGCCCGATGGGCCTCCCAACGGGCCCTCCTCCCCTCCTTG
CACCGAGATTAATAAAAAAAAAAAAAAAAAAAAAAAAAAAAAAAAAAAAAAAAAAAAAAAA
AAAAAAAAAAAAAAAATGCATCAAAGGCTCTTTTCAGAGCCACCA

Figure 31 nucleotide sequence of HSD17B4 – PpLuc(GC) – ag – A64 – histoneSL

GGGTCCCGCAGTCGGCGTCCAGCGGCTCTGCTTGTTCGTGTGTGTGTCGTTGCAGGCCTT
ATTCAAGCTTGAGGATGGAGGACGCCAAGAACATCAAGAAGGGCCCGGCGCCCTTCTACC
CGCTGGAGGACGGGACCGCCGGCGAGCAGCTCCACAAGGCCATGAAGCGGTACGCCCTGG
TGCCGGGCACGATCGCCTTCACCGACGCCCACATCGAGGTCGACATCACCTACGCGGAGT
ACTTCGAGATGAGCGTGCGCCTGGCCGAGGCCATGAAGCGGTACGGCCTGAACACCAACC
ACCGGATCGTGGTGTGCTCGGAGAACAGCCTGCAGTTCTTCATGCCGGTGCTGGGCGCCC
TCTTCATCGGCGTGGCCGTCGCCCCGGCAACGACATCTACAACGAGCGGGAGCTGCTGA
ACAGCATGGGGATCAGCCAGCCGACCGTGGTGTTCGTGAGCAAGAAGGGCCTGCAGAAGA
TCCTGAACGTGCAGAAGAAGCTGCCCATCATCCAGAAGATCATCATGGACAGCAAGA
CCGACTACCAGGGCTTCCAGTCGATGTACACGTTCGTGACCAGCCACCTCCCGCCGGGCT
TCAACGAGTACGACTTCGTCCCGGAGAGCTTCGACCGGGACAAGACCATCGCCCTGATCA
TGAACAGCAGCGGCAGCACCGGCCTGCCGAAGGGGGTGGCCCTGCCGCACCGGACCGCCT
GCGTGCGCTTCTCGCACGCCCGGGACCCCATCTTCGGCAACCAGATCATCCCGGACACCG
CCATCCTGAGCGTGGTGCCGTTCCACCACGGCTTCGGCATGTTCACGACCCTGGGCTACC
TCATCTGCGGCTTCCGGGTGGTCCTGATGTACCGGTTCGAGGAGGAGCTGTTCCTGCGGA
GCCTGCAGGACTACAAGATCCAGAGCGCGCTGCTCGTGCCGACCCTGTTCAGCTTCTTCG
CCAAGAGCACCCTGATCGACAAGTACGACCTGTCGAACCTGCACGAGATCGCCAGCGGGG
GCGCCCCGCTGAGCAAGGAGGTGGGCGAGGCCGTGGCCAAGCGGTTCCACCTCCCGGGCA
TCCGCCAGGGCTACGGCCTGACCGAGACCACGAGCGCGATCCTGATCACCCCCGAGGGGG
ACGACAAGCCGGGCGCCGTGGGCAAGGTGGTCCCGTTCTTCGAGGCCAAGGTGGTGGACC
TGGACACCGGCAAGACCCTGGGCGTGAACCAGCGGGGCGAGCTGTGCGTGCGGGGGCCGA
TGATCATGAGCGGCTACGTGAACAACCCGGAGGCCACCAACGCCCTCATCGACAAGGACG
GCTGGCTGCACAGCGGCGACATCGCCTACTGGGACGAGGACGAGCACTTCTTCATCGTCG
ACCGGCTGAAGTCGCTGATCAAGTACAAGGGCTACCAGGTGGCGCCGGCCGAGCTGGAGA
GCATCCTGCTCCAGCACCCCAACATCTTCGACGCCGGCGTGGCCGGGCTGCCGGACGACG
ACGCCGGCGAGCTGCCGGCCGCGGTGGTGGTGCTGGAGCACGGCAAGACCATGACGGAGA
AGGAGATCGTCGACTACGTGGCCAGCCAGGTGACCACCGCCAAGAAGCTGCGGGGCGGCG
TGGTGTTCGTGGACGAGGTCCCGAAGGGCCTGACCGGGAAGCTCGACGCCCGGAAGATCC
GCGAGATCCTGATCAAGGCCAAGAAGGGCGGCAAGATCGCCGTGTAAGACTAGTTATAAG
ACTGACTAGCCCGATGGGCCTCCCAACGGGCCCTCCTCCCCTCCTTGCACCGAGATTAAT
AAAAAAAAAAAAAAAAAAAAAAAAAAAAAAAAAAAAAAAAAAAAAAAAAAAAAAAAAAAAA
AAAATGCATCAAAGGCTCTTTTCAGAGCCACCA

Figure 32 nucleotide sequence of AlG1 – PpLuc(GC) – ag – A64 – histoneSL

GGGCCGCCCAGCCGGTCCAGGCCTCTGGCGAACAAGCTTGAGGATGGAGGACGCCAAGAA
CATCAAGAAGGGCCCGGCGCCCTTCTACCCGCTGGAGGACGGGACCGCCGGCGAGCAGCT
CCACAAGGCCATGAAGCGGTACGCCCTGGTGCCGGGCACGATCGCCTTCACCGACGCCCA
CATCGAGGTCGACATCACCTACGCGGAGTACTTCGAGATGAGCGTGCGCCTGGCCGAGGC
CATGAAGCGGTACGGCCTGAACACCAACCACCGGATCGTGGTGTGCTCGGAGAACAGCCT
GCAGTTCTTCATGCCGGTGCTGGGCGCCCTCTTCATCGGCGTGGCCGTCGCCCCGGCGAA
CGACATCTACAACGAGCGGGAGCTGCTGAACAGCATGGGGATCAGCCAGCCGACCGTGGT
GTTCGTGAGCAAGAAGGGCCTGCAGAAGATCCTGAACGTGCAGAAGAAGCTGCCCATCAT
CCAGAAGATCATCATCATGGACAGCAAGACCGACTACCAGGGCTTCCAGTCGATGTACAC
GTTCGTGACCAGCCACCTCCCGCCGGGCTTCAACGAGTACGACTTCGTCCCGGAGAGCTT
CGACCGGGACAAGACCATCGCCCTGATCATGAACAGCAGCGGCAGCACCGGCCTGCCGAA
GGGGGTGGCCCTGCCGCACCGGACCGCCTGCGTGCGCTTCTCGCACGCCCGGGACCCCAT
CTTCGGCAACCAGATCATCCCGGACACCGCCATCCTGAGCGTGGTGCCGTTCCACCACGG
CTTCGGCATGTTCACGACCCTGGGCTACCTCATCTGCGGCTTCCGGGTGGTCCTGATGTA
CCGGTTCGAGGAGGAGCTGTTCCTGCGGAGCCTGCAGGACTACAAGATCCAGAGCGCGCT
GCTCGTGCCGACCCTGTTCAGCTTCTTCGCCAAGAGCACCCTGATCGACAAGTACGACCT
GTCGAACCTGCACGAGATCGCCAGCGGGGGCGCCCCGCTGAGCAAGGAGGTGGGCGAGGC
CGTGGCCAAGCGGTTCCACCTCCCGGGCATCCGCCAGGGCTACGGCCTGACCGAGACCAC
GAGCGCGATCCTGATCACCCCCGAGGGGGACGACAAGCCGGGCGCCGTGGGCAAGGTGGT
CCCGTTCTTCGAGGCCAAGGTGGTGGACCTGGACACCGGCAAGACCCTGGGCGTGAACCA
GCGGGGCGAGCTGTGCGTGCGGGGGCCGATGATCATGAGCGGCTACGTGAACAACCCGGA
GGCCACCAACGCCCTCATCGACAAGGACGGCTGGCTGCACAGCGGCGACATCGCCTACTG
GGACGAGGACGAGCACTTCTTCATCGTCGACCGGCTGAAGTCGCTGATCAAGTACAAGGG
CTACCAGGTGGCGCCGGCCGAGCTGGAGAGCATCCTGCTCCAGCACCCCAACATCTTCGA
CGCCGGCGTGGCCGGGCTGCCGGACGACGACGCCGGCGAGCTGCCGGCCGCGGTGGTGGT
GCTGGAGCACGGCAAGACCATGACGGAGAAGGAGATCGTCGACTACGTGGCCAGCCAGGT
GACCACCGCCAAGAAGCTGCGGGGCGGCGTGGTGTTCGTGGACGAGGTCCCGAAGGGCCT
GACCGGGAAGCTCGACGCCCGGAAGATCCGCGAGATCCTGATCAAGGCCAAGAAGGGCGG
CAAGATCGCCGTGTAAGACTAGTTATAAGACTGACTAGCCCGATGGGCCTCCCAACGGGC
CCTCCTCCCCTCCTTGCACCGAGATTAATAAAAAAAAAAAAAAAAAAAAAAAAAAAAAA
AAAAAAAAAAAAAAAAAAAAAAAAAAAAAAAATGCATCAAAGGCTCTTTTCAGAGCCAC
CA

Figure 33 nucleotide sequence of COX6C – PpLuc(GC) – ag – A64 – histoneSL

GGAGTCAGGAAGGACGTTGGTGTTGAGGTTAGCATACGTATCAAGGACAGTAACTACCAA
GCTTGAGGATGGAGGACGCCAAGAACATCAAGAAGGGCCCGGCGCCCTTCTACCCGCTGG
AGGACGGGACCGCCGGCGAGCAGCTCCACAAGGCCATGAAGCGGTACGCCCTGGTGCCGG
GCACGATCGCCTTCACCGACGCCCACATCGAGGTCGACATCACCTACGCGGAGTACTTCG
AGATGAGCGTGCGCCTGGCCGAGGCCATGAAGCGGTACGGCCTGAACACCAACCACCGGA
TCGTGGTGTGCTCGGAGAACAGCCTGCAGTTCTTCATGCCGGTGCTGGGCGCCCTCTTCA
TCGGCGTGGCCGTCGCCCCGGCGAACGACATCTACAACGAGCGGGAGCTGCTGAACAGCA
TGGGGATCAGCCAGCCGACCGTGGTGTTCGTGAGCAAGAAGGGCCTGCAGAAGATCCTGA
ACGTGCAGAAGAAGCTGCCCATCATCCAGAAGATCATCATCATGGACAGCAAGACCGACT
ACCAGGGCTTCCAGTCGATGTACACGTTCGTGACCAGCCACCTCCCGCCGGGCTTCAACG
AGTACGACTTCGTCCCGGAGAGCTTCGACCGGGACAAGACCATCGCCCTGATCATGAACA
GCAGCGGCAGCACCGGCCTGCCGAAGGGGGTGGCCCTGCCGCACCGGACCGCCTGCGTGC
GCTTCTCGCACGCCCGGGACCCCATCTTCGGCAACCAGATCATCCCGGACACCGCCATCC
TGAGCGTGGTGCCGTTCCACCACGGCTTCGGCATGTTCACGACCCTGGGCTACCTCATCT
GCGGCTTCCGGGTGGTCCTGATGTACCGGTTCGAGGAGGAGCTGTTCCTGCGGAGCCTGC
AGGACTACAAGATCCAGAGCGCGCTGCTCGTGCCGACCCTGTTCAGCTTCTTCGCCAAGA
GCACCCTGATCGACAAGTACGACCTGTCGAACCTGCACGAGATCGCCAGCGGGGGCGCCC
CGCTGAGCAAGGAGGTGGGCGAGGCCGTGGCCAAGCGGTTCCACCTCCCGGGCATCCGCC
AGGGCTACGGCCTGACCGAGACCACGAGCGCGATCCTGATCACCCCCGAGGGGGACGACA
AGCCGGGCGCCGTGGGCAAGGTGGTCCCGTTCTTCGAGGCCAAGGTGGTGGACCTGGACA
CCGGCAAGACCCTGGGCGTGAACCAGCGGGGCGAGCTGTGCGTGCGGGGGCCGATGATCA
TGAGCGGCTACGTGAACAACCCGGAGGCCACCAACGCCCTCATCGACAAGGACGGCTGGC
TGCACAGCGGCGACATCGCCTACTGGGACGAGGACGAGCACTTCTTCATCGTCGACCGGC
TGAAGTCGCTGATCAAGTACAAGGGCTACCAGGTGGCGCCGGCCGAGCTGGAGAGCATCC
TGCTCCAGCACCCCAACATCTTCGACGCCGGCGTGGCCGGGCTGCCGGACGACGACGCCG
GCGAGCTGCCGGCCGCGGTGGTGGTGCTGGAGCACGGCAAGACCATGACGGAGAAGGAGA
TCGTCGACTACGTGGCCAGCCAGGTGACCACCGCCAAGAAGCTGCGGGGCGGCGTGGTGT
TCGTGGACGAGGTCCCGAAGGGCCTGACCGGGAAGCTCGACGCCCGGAAGATCCGCGAGA
TCCTGATCAAGGCCAAGAAGGGCGGCAAGATCGCCGTGTAAGACTAGTTATAAGACTGAC
TAGCCCGATGGGCCTCCCAACGGGCCCTCCTCCCTCCTTGCACCGAGATTAATAAAAA
AAAAAAAAAAAAAAAAAAAAAAAAAAAAAAAAAAAAAAAAAAAAAAAAAAAAAAAAAAAA
TGCATCAAAGGCTCTTTTCAGAGCCACCA

Figure 34 nucleotide sequence of ASAH1 – PpLuc(GC) – ag – A64 – histoneSL

GGGCCTCTGCTGGAGTCCGGGGAGTGGCGTTGGCTGCTAGAGCGAAGCTTGAGGATGGAG
GACGCCAAGAACATCAAGAAGGGCCCGGCGCCCTTCTACCCGCTGGAGGACGGGACCGCC
GGCGAGCAGCTCCACAAGGCCATGAAGCGGTACGCCCTGGTGCCGGGCACGATCGCCTTC
ACCGACGCCCACATCGAGGTCGACATCACCTACGCGGAGTACTTCGAGATGAGCGTGCGC
CTGGCCGAGGCCATGAAGCGGTACGGCCTGAACACCAACCACCGGATCGTGGTGTGCTCG
GAGAACAGCCTGCAGTTCTTCATGCCGGTGCTGGGCGCCCTCTTCATCGGCGTGGCCGTC
GCCCCGGCGAACGACATCTACAACGAGCGGGAGCTGCTGAACAGCATGGGGATCAGCCAG
CCGACCGTGGTGTTCGTGAGCAAGAAGGGCCTGCAGAAGATCCTGAACGTGCAGAAGAAG
CTGCCCATCATCCAGAAGATCATCATCATGGACAGCAAGACCGACTACCAGGGCTTCCAG
TCGATGTACACGTTCGTGACCAGCCACCTCCCGCCGGGCTTCAACGAGTACGACTTCGTC
CCGGAGAGCTTCGACCGGGACAAGACCATCGCCCTGATCATGAACAGCAGCGGCAGCACC
GGCCTGCCGAAGGGGGTGGCCCTGCCGCACCGGACCGCCTGCGTGCGCTTCTCGCACGCC
CGGGACCCCATCTTCGGCAACCAGATCATCCCGGACACCGCCATCCTGAGCGTGGTGCCG
TTCCACCACGGCTTCGGCATGTTCACGACCCTGGGCTACCTCATCTGCGGCTTCCGGGTG
GTCCTGATGTACCGGTTCGAGGAGGAGCTGTTCCTGCGGAGCCTGCAGGACTACAAGATC
CAGAGCGCGCTGCTCGTGCCGACCCTGTTCAGCTTCTTCGCCAAGAGCACCCTGATCGAC
AAGTACGACCTGTCGAACCTGCACGAGATCGCCAGCGGGGGCGCCCCGCTGAGCAAGGAG
GTGGGCGAGGCCGTGGCCAAGCGGTTCCACCTCCCGGGCATCCGCCAGGGCTACGGCCTG
ACCGAGACCACGAGCGCGATCCTGATCACCCCCGAGGGGGACGACAAGCCGGGCGCCGTG
GGCAAGGTGGTCCCGTTCTTCGAGGCCAAGGTGGTGGACCTGGACACCGGCAAGACCCTG
GGCGTGAACCAGCGGGGCGAGCTGTGCGTGCGGGGCCGATGATCATGAGCGGCTACGTG
AACAACCCGGAGGCCACCAACGCCCTCATCGACAAGGACGGCTGGCTGCACAGCGGCGAC
ATCGCCTACTGGGACGAGGACGAGCACTTCTTCATCGTCGACCGGCTGAAGTCGCTGATC
AAGTACAAGGGCTACCAGGTGGCGCCGGCCGAGCTGGAGAGCATCCTGCTCCAGCACCCC
AACATCTTCGACGCCGGCGTGGCCGGGCTGCCGGACGACGACGCCGGCGAGCTGCCGGCC
GCGGTGGTGGTGCTGGAGCACGGCAAGACCATGACGGAGAAGGAGATCGTCGACTACGTG
GCCAGCCAGGTGACCACCGCCAAGAAGCTGCGGGGCGGCGTGGTGTTCGTGGACGAGGTC
CCGAAGGGCCTGACCGGGAAGCTCGACGCCCGGAAGATCCGCGAGATCCTGATCAAGGCC
AAGAAGGGCGGCAAGATCGCCGTGTAAGACTAGTTATAAGACTGACTAGCCCGATGGGCC
TCCCAACGGGCCCTCCTCCCTCCTTGCACCGAGATTAATAAAAAAAAAAAAAAAAAAAAA
AAAAAAAAAAAAAAAAAAAAAAAAAAAAAAAAAAAAAAAAAAAAATGCATCAAAGGCTCTT
TTCAGAGCCACCA nucleotide sequence of mRPL21 – PpLuc(GC) – albumin7 – A64 – C30 – histoneSL GGGGCCGCCGCAGCCATCTTCCAGTAACTCGCCAAAAAGCTTGAGGATGGAGGACGCCAA
GAACATCAAGAAGGGCCCGGCGCCCTTCTACCCGCTGGAGGACGGGACCGCCGGCGAGCA
GCTCCACAAGGCCATGAAGCGGTACGCCCTGGTGCCGGGCACGATCGCCTTCACCGACGC
CCACATCGAGGTCGACATCACCTACGCGGAGTACTTCGAGATGAGCGTGCGCCTGGCCGA
GGCCATGAAGCGGTACGGCCTGAACACCAACCACCGGATCGTGGTGTGCTCGGAGAACAG
CCTGCAGTTCTTCATGCCGGTGCTGGGCGCCCTCTTCATCGGCGTGGCCGTCGCCCCGGC
GAACGACATCTACAACGAGCGGGAGCTGCTGAACAGCATGGGGATCAGCCAGCCGACCGT
GGTGTTCGTGAGCAAGAAGGGCCTGCAGAAGATCCTGAACGTGCAGAAGAAGCTGCCCAT
CATCCAGAAGATCATCATCATGGACAGCAAGACCGACTACCAGGGCTTCCAGTCGATGTA
CACGTTCGTGACCAGCCACCTCCCGCCGGGCTTCAACGAGTACGACTTCGTCCCGGAGAG
CTTCGACCGGGACAAGACCATCGCCCTGATCATGAACAGCAGCGGCAGCACCGGCCTGCC
GAAGGGGGTGGCCCTGCCGCACCGGACCGCCTGCGTGCGCTTCTCGCACGCCCGGGACCC
CATCTTCGGCAACCAGATCATCCCGGACACCGCCATCCTGAGCGTGGTGCCGTTCCACCA
CGGCTTCGGCATGTTCACGACCCTGGGCTACCTCATCTGCGGCTTCCGGGTGGTCCTGAT
GTACCGGTTCGAGGAGGAGCTGTTCCTGCGGAGCCTGCAGGACTACAAGATCCAGAGCGC
GCTGCTCGTGCCGACCCTGTTCAGCTTCTTCGCCAAGAGCACCCTGATCGACAAGTACGA
CCTGTCGAACCTGCACGAGATCGCCAGCGGGGCGCCCCGCTGAGCAAGGAGGTGGGCGA
GGCCGTGGCCAAGCGGTTCCACCTCCCGGGCATCCGCCAGGGCTACGGCCTGACCGAGAC
CACGAGCGCGATCCTGATCACCCCCGAGGGGACGACAAGCCGGGCGCCGTGGGCAAGGT
GGTCCCGTTCTTCGAGGCCAAGGTGGTGGACCTGGACACCGGCAAGACCCTGGGCGTGAA
CCAGCGGGGCGAGCTGTGCGTGCGGGGCCGATGATCATGAGCGGCTACGTGAACAACCC
GGAGGCCACCAACGCCCTCATCGACAAGGACGGCTGGCTGCACAGCGGCGACATCGCCTA
CTGGGACGAGGACGAGCACTTCTTCATCGTCGACCGGCTGAAGTCGCTGATCAAGTACAA
GGGCTACCAGGTGGCGCCGGCCGAGCTGGAGAGCATCCTGCTCCAGCACCCCAACATCTT
CGACGCCGGCGTGGCCGGGCTGCCGGACGACGACGCCGGCGAGCTGCCGGCCGCGGTGGT
GGTGCTGGAGCACGGCAAGACCATGACGGAGAAGGAGATCGTCGACTACGTGGCCAGCCA
GGTGACCACCGCCAAGAAGCTGCGGGGCGGCGTGGTGTTCGTGGACGAGGTCCCGAAGGG
CCTGACCGGGAAGCTCGACGCCCGGAAGATCCGCGAGATCCTGATCAAGGCCAAGAAGGG
CGGCAAGATCGCCGTGTAAGACTAGTGCATCACATTTAAAAGCATCTCAGCCTACCATGA
GAATAAGAGAAAGAAAATGAAGATCAATAGCTTATTCATCTCTTTTTCTTTTTCGTTGGT
GTAAAGCCAACACCCTGTCTAAAAAACATAAATTTCTTTAATCATTTTGCCTCTTTTCTC
TGTGCTTCAATTAATAAAAAATGGAAGAACCTAGATCTAAAAAAAAAAAAAAAAAAAAA
AAAAAAAAAAAAAAAAAAAAAAAAAAAAAAAAAAAAAAAAAAATGCATCCCCCCCCCCC
CCCCCCCCCCCCCCCCCAAAGGCTCTTTTCAGAGCCACCAGAATT

Figure 37 nucleotide sequence of mRPL35A – PpLuc(GC) – albumin7 – A64 – C30 – histoneSL

GGGCCATCTTGGCGCCTGTGGAGGCCTGCTGGGAACAGGACTTCTAACAGCAAGTAAGCT
TGAGGATGGAGGACGCCAAGAACATCAAGAAGGGCCCGGCGCCCTTCTACCCGCTGGAGG
ACGGGACCGCCGGCGAGCAGCTCCACAAGGCCATGAAGCGGTACGCCCTGGTGCCGGGCA
CGATCGCCTTCACCGACGCCCACATCGAGGTCGACATCACCTACGCGGAGTACTTCGAGA
TGAGCGTGCGCCTGGCCGAGGCCATGAAGCGGTACGGCCTGAACACCAACCACCGGATCG
TGGTGTGCTCGGAGAACAGCCTGCAGTTCTTCATGCCGGTGCTGGGCGCCCTCTTCATCG
GCGTGGCCGTCGCCCCGGCGAACGACATCTACAACGAGCGGGAGCTGCTGAACAGCATGG
GGATCAGCCAGCCGACCGTGGTGTTCGTGAGCAAGAAGGGCCTGCAGAAGATCCTGAACG
TGCAGAAGAAGCTGCCCATCATCCAGAAGATCATCATCATGGACAGCAAGACCGACTACC
AGGGCTTCCAGTCGATGTACACGTTCGTGACCAGCCACCTCCCGCCGGGCTTCAACGAGT
ACGACTTCGTCCCGGAGAGCTTCGACCGGGACAAGACCATCGCCCTGATCATGAACAGCA
GCGGCAGCACCGGCCTGCCGAAGGGGGTGGCCCTGCCGCACCGGACCGCCTGCGTGCGCT
TCTCGCACGCCCGGGACCCCATCTTCGGCAACCAGATCATCCCGGACACCGCCATCCTGA
GCGTGGTGCCGTTCCACCACGGCTTCGGCATGTTCACGACCCTGGGCTACCTCATCTGCG
GCTTCCGGGTGGTCCTGATGTACCGGTTCGAGGAGGAGCTGTTCCTGCGGAGCCTGCAGG
ACTACAAGATCCAGAGCGCGCTGCTCGTGCCGACCCTGTTCAGCTTCTTCGCCAAGAGCA
CCCTGATCGACAAGTACGACCTGTCGAACCTGCACGAGATCGCCAGCGGGGGCGCCCCGC
TGAGCAAGGAGGTGGGCGAGGCCGTGGCCAAGCGGTTCCACCTCCCGGGCATCCGCCAGG
GCTACGGCCTGACCGAGACCACGAGCGCGATCCTGATCACCCCCGAGGGGGACGACAAGC
CGGGCGCCGTGGGCAAGGTGGTCCCGTTCTTCGAGGCCAAGGTGGTGGACCTGGACACCG
GCAAGACCCTGGGCGTGAACCAGCGGGGCGAGCTGTGCGTGCGGGGCCGATGATCATGA
GCGGCTACGTGAACAACCCGGAGGCCACCAACGCCCTCATCGACAAGGACGGCTGGCTGC
ACAGCGGCGACATCGCCTACTGGGACGAGGACGAGCACTTCTTCATCGTCGACCGGCTGA
AGTCGCTGATCAAGTACAAGGGCTACCAGGTGGCGCCGGCCGAGCTGGAGAGCATCCTGC
TCCAGCACCCCAACATCTTCGACGCCGGCGTGGCCGGGCTGCCGGACGACGACGCCGGCG
AGCTGCCGGCCGCGGTGGTGGTGCTGGAGCACGGCAAGACCATGACGGAGAAGGAGATCG
TCGACTACGTGGCCAGCCAGGTGACCACCGCCAAGAAGCTGCGGGGCGGCGTGGTGTTCG
TGGACGAGGTCCCGAAGGGCCTGACCGGGAAGCTCGACGCCCGGAAGATCCGCGAGATCC
TGATCAAGGCCAAGAAGGGCGGCAAGATCGCCGTGTAAGACTAGTGCATCACATTTAAAA
GCATCTCAGCCTACCATGAGAATAAGAGAAAGAAAATGAAGATCAATAGCTTATTCATCT
CTTTTTCTTTTTCGTTGGTGTAAAGCCAACACCCTGTCTAAAAAACATAAATTTCTTTAA
TCATTTTGCCTCTTTTCTCTGTGCTTCAATTAATAAAAAATGGAAAGAACCTAGATCTAA
AAAAAAAAAAAAAAAAAAAAAAAAAAAAAAAAAAAAAAAAAAAAAAAAAAAAAAAAAAAA
AATGCATCCCCCCCCCCCCCCCCCCCCCCCCCCCCCAAAGGCTCTTTTCAGAGCCACC
AGAATT

Figure 38

ARTIFICIAL NUCLEIC ACID MOLECULES FOR IMPROVED PROTEIN OR PEPTIDE EXPRESSION

This application is a national phase application under 35 U.S.C. §371 of International Application No. PCT/EP2013/000937, filed Mar. 27, 2013, which claims priority to International Application No. PCT/EP2012/001336, filed Mar. 27, 2012, and International Application No. PCT/EP2012/002447, filed Jun. 8, 2012. The entire text of each of the above referenced disclosures is specifically incorporated herein by reference.

The invention relates to artificial nucleic acid molecules comprising a 5'UTR element derived from the 5'UTR of a TOP gene, an open reading frame, and optionally a histone stem-loop, a 3'UTR element, a poly(A) sequence and/or a polyadenylation signal. The invention relates further to a vector comprising a 5'UTR element derived from the 5'UTR of a TOP gene, to a pharmaceutical composition comprising the artificial nucleic acid molecule or the vector, and to a kit comprising the artificial nucleic acid molecule, the vector and/or the pharmaceutical composition, preferably for use in the field of gene therapy and/or genetic vaccination.

Gene therapy and genetic vaccination belong to the most promising and quickly developing methods of modern medicine. They may provide highly specific and individual options for therapy of a large variety of diseases. Particularly, inherited genetic diseases but also autoimmune diseases, cancerous or tumour-related diseases as well as inflammatory diseases may be the subject of such treatment approaches. Also, it is envisaged to prevent (early) onset of such diseases by these approaches.

The main conceptual rational behind gene therapy is appropriate modulation of impaired gene expression associated with pathological conditions of specific diseases. Pathologically altered gene expression may result in lack or overproduction of essential gene products, for example, signalling factors such as hormones, housekeeping factors, metabolic enzymes, structural proteins or the like. Altered gene expression may not only be due to misregulation of transcription and/or translation, but also due to mutations within the ORF coding for a particular protein. Pathological mutations may be caused by e.g. chromosomal aberration, or by more specific mutations, such as point or frame-shift-mutations, all of them resulting in limited functionality and, potentially, total loss of function of the gene product. However, misregulation of transcription or translation may also occur, if mutations affect genes encoding proteins which are involved in the transcriptional or translational machinery of the cell. Such mutations may lead to pathological up- or down-regulation of genes which are—as such—functional. Genes encoding gene products which exert such regulating functions, may be, e.g., transcription factors, signal receptors, messenger proteins or the like. However, loss of function of such genes encoding regulatory proteins may, under certain circumstances, be reversed by artificial introduction of other factors acting further downstream of the impaired gene product. Such gene defects may also be compensated by gene therapy via substitution of the affected gene itself.

Genetic vaccination allows to evoke a desired immune response to selected antigens, such as characteristic components of bacterial surfaces, viral particles, tumour antigens or the like. Generally, vaccination is one of the pivotal achievements of modern medicine. However, effective vaccines are currently available only for a smaller number of diseases. Accordingly, infections that are not preventable by vaccination still affect millions of people every year.

Commonly, vaccines may be subdivided into "first", "second" and "third" generation vaccines. "First generation" vaccines are, typically, whole-organism vaccines. They are based on either live and attenuated or killed pathogens, e.g. viruses, bacteria or the like. The major drawback of live and attenuated vaccines is the risk for a reversion to life-threatening variants. Thus, although attenuated, such pathogens may still intrinsically bear unpredictable risks. Killed pathogens may not be as effective as desired for generating a specific immune response. In order to minimize these risks, "second generation" vaccines were developed. These are, typically, subunit vaccines, consisting of defined antigens or recombinant protein components which are derived from pathogens.

Genetic vaccines, i.e. vaccines for genetic vaccination, are usually understood as "third generation" vaccines. They are typically composed of genetically engineered nucleic acid molecules which allow expression of peptide or protein (antigen) fragments characteristic for a pathogen or a tumor antigen in vivo. Genetic vaccines are expressed upon administration to a patient and uptake by competent cells. Expression of the administered nucleic acids results in production of the encoded proteins. In the event these proteins are recognized as foreign by the patient's immune system, an immune response is triggered.

As can be seen from the above, both methods, gene therapy and genetic vaccination, are essentially based on the administration of nucleic acid molecules to a patient and subsequent transcription and/or translation of the encoded genetic information. Alternatively, genetic vaccination or gene therapy may also comprise methods which include isolation of specific body cells from a patient to be treated, subsequent in vitro transfection of such cells, and re-administration of the treated cells to the patient.

DNA as well as RNA may be used as nucleic acid molecules for administration in the context of gene therapy or genetic vaccination. DNA is known to be relatively stable and easy to handle. However, the use of DNA bears the risk of undesired insertion of the administered DNA-fragments into the patient's genome potentially resulting in loss of function of the impaired genes. As a further risk, the undesired generation of anti-DNA antibodies has emerged. Another drawback is the limited expression level of the encoded peptide or protein that is achievable upon DNA administration and its transcription/translation. Among other reasons, the expression level of the administered DNA will be dependent on the presence of specific transcription factors which regulate DNA transcription. In the absence of such factors, DNA transcription will not yield satisfying amounts of RNA. As a result, the level of translated peptide or protein obtained is limited.

By using RNA instead of DNA for gene therapy or genetic vaccination, the risk of undesired genomic integration and generation of anti-DNA antibodies is minimized or avoided. However, RNA is considered to be a rather unstable molecular species which may readily be degraded by ubiquitous RNAses.

In vivo, RNA-degradation contributes to the regulation of the RNA half-life time. That effect was considered and proven to fine tune the regulation of eukaryotic gene expression (Friedel et al., Conserved principles of mammalian transcriptional regulation revealed by RNA half-life, Nucleic Acid Research, 2009, 1-12). Accordingly, each naturally occurring mRNA has its individual half-life depending on the gene from which the mRNA is derived. It contributes to the regulation of the expression level of this gene. Unstable RNAs are important to realize transient gene expression at distinct points in time. However, long-lived RNAs may be associated with accumulation of distinct proteins or continuous expression of genes. In vivo, the half life of mRNAs may also be dependent on environmental factors, such as hormonal treatment, as has been shown, e.g., for insulin-like growth factor I, actin, and albumin mRNA (Johnson et al, Newly synthesized RNA: Simultaneous measurement in intact cells of transcription rates and RNA stability of insulin-like growth factor I, actin, and albumin in growth hormone-stimulated hepatocytes, Proc. Natl. Acad. Sci., Vol. 88, pp. 5287-5291, 1991).

For gene therapy and genetic vaccination, usually stable RNA is desired. This is, on the one hand, due to the fact that the product encoded by the RNA-sequence shall accumulate in vivo. On the other hand, the RNA has to maintain its structural and functional integrity when prepared for a suitable dosage form, in the course of its storage, and when administered. Thus, considerable attention was dedicated to provide stable RNA molecules for gene therapy or genetic vaccination in order to prevent them from being subject to early degradation or decay.

It has been reported that the G/C-content of nucleic acid molecules may influence their stability. Thus, nucleic acids comprising an increased amount of guanine (G) and/or cytosine (C) residues may be functionally more stable than nucleic acids containing a large amount of adenine (A) and thymine (T) or uracil (U) nucleotides. In this context, WO02/098443 provides a pharmaceutical composition containing an mRNA that is stabilised by sequence modifications in the translated region. Such a sequence modification takes advantage of the degeneracy of the genetic code. Accordingly, codons which contain a less favourable combination of nucleotides (less favourable in terms of RNA stability) may be substituted by alternative codons without altering the encoded amino acid sequence. This method of RNA stabilization is limited by the provisions of the specific nucleotide sequence of each single RNA molecule which is not allowed to leave the space of the desired amino acid sequence. Also, that approach is restricted to coding regions of the RNA.

As an alternative option for mRNA stabilisation, it has been found that naturally occurring eukaryotic mRNA molecules contain characteristic stabilising elements. For example, they may comprise so-called untranslated regions (UTR) at their 5'-end (5'UTR) and/or at their 3'-end (3'UTR) as well as other structural features, such as a 5'-cap structure or a 3'-poly(A) tail. Both, 5'UTR and 3'UTR are typically transcribed from the genomic DNA and are, thus, an element of the premature mRNA. Characteristic structural features of mature mRNA, such as the 5'-cap and the 3'-poly(A) tail (also called poly(A) tail or poly(A) sequence) are usually added to the transcribed (premature) mRNA during mRNA processing.

A 3'-poly(A) tail is typically a monotonous sequence stretch of adenine nucleotides added to the 3'-end of the transcribed mRNA. It may comprise up to about 400 adenine nucleotides. It was found that the length of such a 3'-poly(A) tail is a potentially critical element for the stability of the individual mRNA.

Nearly all eukaryotic mRNAs end with such a poly(A) sequence that is added to their 3' end by the ubiquitous cleavage/polyadenylation machinery. The presence of a poly (A) sequence at the 3' end is one of the most recognizable features of eukaryotic mRNAs. After cleavage, most pre-mRNAs, with the exception of replication-dependent histone transcripts, acquire a polyadenylated tail. In this context, 3' end processing is a nuclear co-transcriptional process that promotes transport of mRNAs from the nucleus to the cytoplasm and affects the stability and the translation of mRNAs. Formation of this 3' end occurs in a two step reaction directed by the cleavage/polyadenylation machinery and depends on the presence of two sequence elements in mRNA precursors (pre-mRNAs); a highly conserved hexanucleotide AAUAAA (polyadenylation signal) and a downstream G/U-rich sequence. In a first step, pre-mRNAs are cleaved between these two elements. In a second step tightly coupled to the first step the newly formed 3' end is extended by addition of a poly(A) sequence consisting of 200-250 adenylates which affects subsequently all aspects of mRNA metabolism, including mRNA export, stability and translation (Dominski, Z. and W. F. Marzluff (2007), Gene 396(2): 373-90).

The only known exception to this rule are the replication-dependent histone mRNAs which terminate with a histone stem-loop instead of a poly(A) sequence. Exemplary histone stem-loop sequences are described in Lopez et al. (Dávila López, M., & Samuelsson, T. (2008), RNA (New York, N.Y.), 14(1), 1-10. doi:10.1261/rna.782308).

The stem-loops in histone pre-mRNAs are typically followed by a purine-rich sequence known as the histone downstream element (HDE). These pre-mRNAs are processed in the nucleus by a single endonucleolytic cleavage approximately 5 nucleotides downstream of the stem-loop, catalyzed by the U7 snRNP through base pairing of the U7 snRNA with the HDE.

Due to the requirement to package newly synthesized DNA into chromatin, histone synthesis is regulated in concert with the cell cycle. Increased synthesis of histone proteins during S phase is achieved by transcriptional activation of histone genes as well as posttranscriptional regulation of histone mRNA levels. It could be shown that the histone stem-loop is essential for all posttranscriptional steps of histone expression regulation. It is necessary for efficient processing, export of the mRNA into the cytoplasm, loading onto polyribosomes, and regulation of mRNA stability.

In the above context, a 32 kDa protein was identified, which is associated with the histone stem-loop at the 3'-end of the histone messages in both the nucleus and the cytoplasm. The expression level of this stem-loop binding protein (SLBP) is cell-cycle regulated and is highest during S-phase when histone mRNA levels are increased. SLBP is necessary for efficient 3'-end processing of histone pre-mRNA by the U7 snRNP. After completion of processing, SLBP remains associated with the stem-loop at the end of mature histone mRNAs and stimulates their translation into histone proteins in the cytoplasm. (Dominski, Z. and W. F. Marzluff (2007), Gene 396(2): 373-90). Interestingly, the RNA binding domain of SLBP is conserved throughout metazoa and protozoa (Dávila López, M., & Samuelsson, T. (2008), RNA (New York, N.Y.), 14(1), 1-10. doi:10.1261/rna.782308) and it could be shown that its binding to the histone stem-loop sequence is dependent on the stem-loop structure and that the minimum binding site contains at least 3 nucleotides 5' and 2 nucleotides 3' of the stem-loop (Pandey, N. B., et al. (1994), *Molecular and Cellular Biology,* 14(3), 1709-1720 and Williams, A. S., & Marzluff, W. F., (1995), *Nucleic Acids Research,* 23(4), 654-662).

Even though histone genes are generally classified as either "replication-dependent", giving rise to mRNA ending in a histone stem-loop, or "replacement-type", giving rise to mRNA bearing a poly(A)-tail instead, naturally occurring mRNAs containing both a histone stem-loop and poly(A) or oligo(A) 3' thereof have been identified in some very rare cases. Sanchez et al. examined the effect of naturally occurring oligo(A) tails appended 3' of the histone stem-loop of histone mRNA during *Xenopus* oogenesis using Luciferase as a reporter protein and found that the oligo(A) tail is an active part of the translation repression mechanism that silences histone mRNA during oogenesis and its removal is part of the mechanism that activates translation of histone mRNAs (Sanchez, R. and W. F. Marzluff (2004), Mol Cell Biol 24(6): 2513-25).

Furthermore, the requirements for regulation of replication dependent histones at the level of pre-mRNA processing and mRNA stability have been investigated using artificial constructs coding for the marker protein alpha globin, taking advantage of the fact that the globin gene contains introns as opposed to the intron-less histone genes. For this purpose constructs were generated in which the alpha globin coding sequence was followed by a histone stem-loop signal (histone stem-loop followed by the histone downstream element) and a polyadenylation signal (Whitelaw, E., et al. (1986). Nucleic Acids Research, 14(17), 7059-7070; Pandey, N. B., & Marzluff, W. F. (1987). Molecular and Cellular Biology, 7(12), 4557-4559; Pandey, N. B., et al. (1990). Nucleic Acids Research, 18(11), 3161-3170).

Also, it was shown that the 3'UTR of α-globin mRNA may be an important factor for the well-known stability of α-globin mRNA (Rodgers et al., Regulated α-globin mRNA decay is a cytoplasmic event proceeding through 3'-to-5' exosome-dependent decapping, RNA, 8, pp. 1526-1537, 2002). The 3'UTR of α-globin mRNA is obviously involved in the formation of a specific ribonucleoprotein-complex, the α-complex, whose presence correlates with mRNA stability in vitro (Wang et al., An mRNA stability complex functions with poly(A)-binding protein to stabilize mRNA in vitro, Molecular and Cellular biology, Vol 19, No. 7, July 1999, p. 4552-4560).

Irrespective of factors influencing mRNA stability, effective translation of the administered nucleic acid molecules by the target cells or tissue is crucial for any approach using nucleic acid molecules for gene therapy or genetic vaccination. Along with the regulation of stability, also translation of the majority of mRNAs is regulated by structural features like UTRs, 5'-cap and 3'-poly(A) tail. In this context, it has been reported that the length of the poly(A) tail may play an important role for translational efficiency as well. Stabilizing 3'-elements, however, may also have an attenuating effect on translation.

Further regulative elements, which may have an influence on expression levels, may be found in the 5'UTR. For example, it has been reported that synthesis of particular proteins, e.g. proteins belonging to the translational apparatus, may be regulated not only at the transcriptional but also at the translational level. For example, translation of proteins encoded by so called 'TOP-genes' may be down-regulated by translational repression. Therein, the term 'TOP-gene' relates to a gene corresponding to an mRNA that is characterized by the presence of a TOP sequence at the 5'end and in most cases by a growth-associated translation regulation (Iadevaia et al., All translation elongation factors and the e, f, and h subunits of translation initiation factor 3 are encoded by 5'-terminal oligopyrimidine (TOP) mRNAs; RNA, 2008, 14:1730-1736). In this context, a TOP sequence—also called the '5'-terminal oligopyrimidine tract'—typically consists of a C residue at the cap site, followed by an uninterrupted sequence of up to 13 or even more pyrimidines (Avni et al., Vertebrate mRNAs with a 5'-terminal pyrimidine tract are Candidates for translational repression in quiescent cells: characterization of the translational cis-regulatory element, Molecular and Cellular Biology, 1994, p. 3822-3833). These TOP sequences are reported to be present in many mRNAs encoding components of the translational machinery and to be responsible for selective repression of the translation of these TOP containing mRNAs due to growth arrest (Meyuhas, et al., Translational Control of Ribosomal Protein mRNAs in Eukaryotes, Translational Control. Cold Spring Harbor Monograph Archive. Cold Spring Harbor Laboratory Press, 1996, p. 363-388).

It is the object of the invention to provide nucleic acid molecules which may be suitable for application in gene therapy and/or genetic vaccination. Particularly, it is the object of the invention to provide artificial nucleic acid molecules, such as an mRNA species, which provide for increased protein production from said artificial nucleic acid molecules, preferably which exhibit increased translational efficiency. Another object of the present invention is to provide nucleic acid molecules coding for such a superior mRNA species which may be amenable for use in gene therapy and/or genetic vaccination. It is a further object of the present invention to provide a pharmaceutical composition for use in gene therapy and/or genetic vaccination. In summary, it is the object of the present invention to provide improved nucleic acid species which overcome the above discussed disadvantages of the prior art by a cost-effective and straight-forward approach.

The object underlying the present invention is solved by the claimed subject-matter.

For the sake of clarity and readability the following definitions are provided. Any technical feature mentioned for these definitions may be read on each and every embodiment of the invention. Additional definitions and explanations may be specifically provided in the context of these embodiments.

Adaptive immune response: The adaptive immune response is typically understood to be an antigen-specific response of the immune system. Antigen specificity allows for the generation of responses that are tailored to specific pathogens or pathogen-infected cells. The ability to mount these tailored responses is usually maintained in the body by "memory cells". Should a pathogen infect the body more than once, these specific memory cells are used to quickly eliminate it. In this context, the first step of an adaptive immune response is the activation of naïve antigen-specific T cells or different immune cells able to induce an antigen-specific immune response by antigen-presenting cells. This occurs in the lymphoid tissues and organs through which naïve T cells are constantly passing. The three cell types that may serve as antigen-presenting cells are dendritic cells, macrophages, and B cells. Each of these cells has a distinct function in eliciting immune responses. Dendritic cells may take up antigens by phagocytosis and macropinocytosis and may become stimulated by contact with e.g. a foreign antigen to migrate to the local lymphoid tissue, where they differentiate into mature dendritic cells. Macrophages ingest particulate antigens such as bacteria and are induced by infectious agents or other appropriate stimuli to express MHC molecules. The unique ability of B cells to bind and internalize soluble protein antigens via their receptors may also be important to induce T cells. MHC-molecules are, typically, responsible for presentation of an antigen to T-cells. Therein, presenting the antigen on MHC molecules leads to activation of T cells which induces their proliferation and differentiation into armed effector T cells. The most important function of effector T cells is the killing of infected cells by CD8+ cytotoxic T cells and the activation of macrophages by Th1 cells which together make up cell-mediated immunity, and the activation of B cells by both Th2 and Th1 cells to produce different classes of antibody, thus driving the humoral immune response. T cells recognize an antigen by their T cell receptors which do not recognize and bind the antigen directly, but instead recognize short peptide fragments e.g. of pathogen-derived protein antigens, e.g. so-called epitopes, which are bound to MHC molecules on the surfaces of other cells.

Adaptive immune system: The adaptive immune system is essentially dedicated to eliminate or prevent pathogenic growth. It typically regulates the adaptive immune response by providing the vertebrate immune system with the ability to recognize and remember specific pathogens (to generate immunity), and to mount stronger attacks each time the pathogen is encountered. The system is highly adaptable because of somatic hypermutation (a process of accelerated somatic mutations), and V(D)J recombination (an irreversible genetic recombination of antigen receptor gene segments). This mechanism allows a small number of genes to generate a vast number of different antigen receptors, which are then uniquely expressed on each individual lymphocyte. Because the gene rearrangement leads to an irreversible change in the DNA of each cell, all of the progeny (offspring) of such a cell will then inherit genes encoding the same receptor specificity, including the Memory B cells and Memory T cells that are the keys to long-lived specific immunity.

Adjuvant/adjuvant component: An adjuvant or an adjuvant component in the broadest sense is typically a pharmacological and/or immunological agent that may modify, e.g. enhance, the effect of other agents, such as a drug or vaccine. It is to be interpreted in a broad sense and refers to a broad spectrum of substances. Typically, these substances are able to increase the immunogenicity of antigens. For example, adjuvants may be recognized by the innate immune systems and, e.g., may elicit an innate immune response. "Adjuvants" typically do not elicit an adaptive immune response. Insofar, "adjuvants" do not qualify as antigens. Their mode of action is distinct from the effects triggered by antigens resulting in an adaptive immune response.

Antigen: In the context of the present invention "antigen" refers typically to a substance which may be recognized by the immune system, preferably by the adaptive immune system, and is capable of triggering an antigen-specific immune response, e.g. by formation of antibodies and/or antigen-specific T cells as part of an adaptive immune response. Typically, an antigen may be or may comprise a peptide or protein which may be presented by the MHC to T-cells.

Artificial nucleic acid molecule: An artificial nucleic acid molecule may typically be understood to be a nucleic acid molecule, e.g. a DNA or an RNA, that does not occur naturally. In other words, an artificial nucleic acid molecule may be understood as a non-natural nucleic acid molecule. Such nucleic acid molecule may be non-natural due to its individual sequence (which does not occur naturally) and/or due to other modifications, e.g. structural modifications of nucleotides which do not occur naturally. An artificial nucleic acid molecule may be a DNA molecule, an RNA molecule or a hybrid-molecule comprising DNA and RNA portions. Typically, artificial nucleic acid molecules may be designed and/or generated by genetic engineering methods to correspond to a desired artificial sequence of nucleotides (heterologous sequence). In this context an artificial sequence is usually a sequence that may not occur naturally, i.e. it differs from the wild type sequence by at least one nucleotide. The term 'wild type' may be understood as a sequence occurring in nature. Further, the term 'artificial nucleic acid molecule' is not restricted to mean 'one single molecule' but is, typically, understood to comprise an ensemble of identical molecules. Accordingly, it may relate to a plurality of identical molecules contained in an aliquot.

Bicistronic RNA, multicistronic RNA: A bicistronic or multicistronic RNA is typically an RNA, preferably an mRNA, that typically may have two (bicistronic) or more (multicistronic) open reading frames (ORF). An open reading frame in this context is a sequence of codons that is translatable into a peptide or protein.

Carrier/polymeric carrier: A carrier in the context of the invention may typically be a compound that facilitates transport and/or complexation of another compound (cargo). A polymeric carrier is typically a carrier that is formed of a polymer. A carrier may be associated to its cargo by covalent or non-covalent interaction. A carrier may transport nucleic acids, e.g. RNA or DNA, to the target cells. The carrier may—for some embodiments—be a cationic component.

Cationic component: The term "cationic component" typically refers to a charged molecule, which is positively charged (cation) at a pH value typically from 1 to 9, preferably at a pH value of or below 9 (e.g. from 5 to 9), of or below 8 (e.g. from 5 to 8), of or below 7 (e.g. from 5 to 7), most preferably at a physiological pH, e.g. from 7.3 to 7.4. Accordingly, a cationic component may be any positively charged compound or polymer, preferably a cationic peptide or protein which is positively charged under physiological conditions, particularly under physiological conditions in vivo. A 'cationic peptide or protein' may contain at least one positively charged amino acid, or more than one positively charged amino acid, e.g. selected from Arg, His, Lys or Orn. Accordingly, 'polycationic' components are also within the scope exhibiting more than one positive charge under the conditions given.

5'-cap: A 5'-cap is an entity, typically a modified nucleotide entity, which generally 'caps' the 5'-end of a mature mRNA. A 5'-cap may typically be formed by a modified nucleotide, particularly by a derivative of a guanine nucleotide. Preferably, the 5'-cap is linked to the 5'-terminus via a 5'-5'-triphosphate linkage. A 5'-cap may be methylated, e.g. m7GpppN, wherein N is the terminal 5' nucleotide of the nucleic acid carrying the 5'-cap, typically the 5'-end of an RNA. Further examples of 5'cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety.

Cellular immunity/cellular immune response: Cellular immunity relates typically to the activation of macrophages, natural killer cells (NK), antigen-specific cytotoxic T-lymphocytes, and the release of various cytokines in response to an antigen. In more general terms, cellular immunity is not based on antibodies, but on the activation of cells of the immune system. Typically, a cellular immune response may be characterized e.g. by activating antigen-specific cytotoxic T-lymphocytes that are able to induce apoptosis in cells, e.g.

specific immune cells like dendritic cells or other cells, displaying epitopes of foreign antigens on their surface. Such cells may be virus-infected or infected with intracellular bacteria, or cancer cells displaying tumor antigens. Further characteristics may be activation of macrophages and natural killer cells, enabling them to destroy pathogens and stimulation of cells to secrete a variety of cytokines that influence the function of other cells involved in adaptive immune responses and innate immune responses.

DNA: DNA is the usual abbreviation for deoxy-ribonucleic-acid. It is a nucleic acid molecule, i.e. a polymer consisting of nucleotides. These nucleotides are usually deoxy-adenosine-monophosphate, deoxy-thymidine-monophosphate, deoxy-guanosine-monophosphate and deoxy-cytidine-monophosphate monomers which are—by themselves—composed of a sugar moiety (deoxyribose), a base moiety and a phosphate moiety, and polymerise by a characteristic backbone structure. The backbone structure is, typically, formed by phosphodiester bonds between the sugar moiety of the nucleotide, i.e. deoxyribose, of a first and a phosphate moiety of a second, adjacent monomer. The specific order of the monomers, i.e. the order of the bases linked to the sugar/phosphate-backbone, is called the DNA-sequence. DNA may be single stranded or double stranded. In the double stranded form, the nucleotides of the first strand typically hybridize with the nucleotides of the second strand, e.g. by A/T-base-pairing and G/C-base-pairing.

Epitope: Epitopes (also called 'antigen determinant') can be distinguished in T cell epitopes and B cell epitopes. T cell epitopes or parts of the proteins in the context of the present invention may comprise fragments preferably having a length of about 6 to about 20 or even more amino acids, e.g. fragments as processed and presented by MHC class I molecules, preferably having a length of about 8 to about 10 amino acids, e.g. 8, 9, or 10, (or even 11, or 12 amino acids), or fragments as processed and presented by MHC class II molecules, preferably having a length of about 13 or more amino acids, e.g. 13, 14, 15, 16, 17, 18, 19, 20 or even more amino acids, wherein these fragments may be selected from any part of the amino acid sequence. These fragments are typically recognized by T cells in form of a complex consisting of the peptide fragment and an MHC molecule, i.e. the fragments are typically not recognized in their native form. B cell epitopes are typically fragments located on the outer surface of (native) protein or peptide antigens as defined herein, preferably having 5 to 15 amino acids, more preferably having 5 to 12 amino acids, even more preferably having 6 to 9 amino acids, which may be recognized by antibodies, i.e. in their native form.

Such epitopes of proteins or peptides may furthermore be selected from any of the herein mentioned variants of such proteins or peptides. In this context antigenic determinants can be conformational or discontinuous epitopes which are composed of segments of the proteins or peptides as defined herein that are discontinuous in the amino acid sequence of the proteins or peptides as defined herein but are brought together in the three-dimensional structure or continuous or linear epitopes which are composed of a single polypeptide chain.

Fragment of a sequence: A fragment of a sequence may typically be a shorter portion of a full-length sequence of e.g. a nucleic acid molecule or an amino acid sequence. Accordingly, a fragment, typically, consists of a sequence that is identical to the corresponding stretch within the full-length sequence. A preferred fragment of a sequence in the context of the present invention, consists of a continuous stretch of entities, such as nucleotides or amino acids corresponding to a continuous stretch of entities in the molecule the fragment is derived from, which represents at least 20%, preferably at least 30%, more preferably at least 40%, more preferably at least 50%, even more preferably at least 60%, even more preferably at least 70%, and most preferably at least 80% of the total (i.e. full-length) molecule from which the fragment is derived.

G/C modified: A G/C-modified nucleic acid may typically be a nucleic acid, preferably an artificial nucleic acid molecule as defined herein, based on a modified wild-type sequence comprising a preferably increased number of guanosine and/or cytosine nucleotides as compared to the wild-type sequence. Such an increased number may be generated by substitution of codons containing adenosine or thymidine nucleotides by codons containing guanosine or cytosine nucleotides. If the enriched G/C content occurs in a coding region of DNA or RNA, it makes use of the degeneracy of the genetic code. Accordingly, the codon substitutions preferably do not alter the encoded amino acid residues, but exclusively increase the G/C content of the nucleic acid molecule.

Gene therapy: Gene therapy may typically be understood to mean a treatment of a patient's body or isolated elements of a patient's body, for example isolated tissues/cells, by nucleic acids encoding a peptide or protein. It typically may comprise at least one of the steps of a) administration of a nucleic acid, preferably an artificial nucleic acid molecule as defined herein, directly to the patient—by whatever administration route—or in vitro to isolated cells/tissues of the patient, which results in transfection of the patient's cells either in vivo/ex vivo or in vitro; b) transcription and/or translation of the introduced nucleic acid molecule; and optionally c) re-administration of isolated, transfected cells to the patient, if the nucleic acid has not been administered directly to the patient.

Genetic vaccination: Genetic vaccination may typically be understood to be vaccination by administration of a nucleic acid molecule encoding an antigen or an immunogen or fragments thereof. The nucleic acid molecule may be administered to a subject's body or to isolated cells of a subject. Upon transfection of certain cells of the body or upon transfection of the isolated cells, the antigen or immunogen may be expressed by those cells and subsequently presented to the immune system, eliciting an adaptive, i.e. antigen-specific immune response. Accordingly, genetic vaccination typically comprises at least one of the steps of a) administration of a nucleic acid, preferably an artificial nucleic acid molecule as defined herein, to a subject, preferably a patient, or to isolated cells of a subject, preferably a patient, which usually results in transfection of the subject's cells either in vivo or in vitro; b) transcription and/or translation of the introduced nucleic acid molecule; and optionally c) re-administration of isolated, transfected cells to the subject, preferably the patient, if the nucleic acid has not been administered directly to the patient.

Heterologous sequence: Two sequences are typically understood to be 'heterologous' if they are not derivable from the same gene. I.e., although heterologous sequences may be derivable from the same organism, they naturally (in nature) do not occur in the same nucleic acid molecule, such as in the same mRNA.

Humoral immunity/humoral immune response: Humoral immunity refers typically to antibody production and optionally to accessory processes accompanying antibody production. A humoral immune response may be typically characterized, e.g., by Th2 activation and cytokine production, germinal center formation and isotype switching, affinity maturation and memory cell generation. Humoral immunity also typically may refer to the effector functions of antibodies, which include pathogen and toxin neutralization, classical complement activation, and opsonin promotion of phagocytosis and pathogen elimination.

Immunogen: In the context of the present invention an immunogen may be typically understood to be a compound that is able to stimulate an immune response. Preferably, an immunogen is a peptide, polypeptide, or protein. In a particularly preferred embodiment, an immunogen in the sense of the present invention is the product of translation of a provided nucleic acid molecule, preferably an artificial nucleic acid molecule as defined herein. Typically, an immunogen elicits at least an adaptive immune response.

Immunostimulatory composition: In the context of the invention, an immunostimulatory composition may be typically understood to be a composition containing at least one component which is able to induce an immune response or from which a component which is able to induce an immune response is derivable. Such immune response may be preferably an innate immune response or a combination of an adaptive and an innate immune response. Preferably, an immunostimulatory composition in the context of the invention contains at least one artificial nucleic acid molecule, more preferably an RNA, for example an mRNA molecule. The immunostimulatory component, such as the mRNA may be complexed with a suitable carrier. Thus, the immunostimulatory composition may comprise an mRNA/carrier-complex. Furthermore, the immunostimulatory composition may comprise an adjuvant and/or a suitable vehicle for the immunostimulatory component, such as the mRNA.

Immune response: An immune response may typically be a specific reaction of the adaptive immune system to a particular antigen (so called specific or adaptive immune response) or an unspecific reaction of the innate immune system (so called unspecific or innate immune response), or a combination thereof.

Immune system: The immune system may protect organisms from infection. If a pathogen succeeds in passing a physical barrier of an organism and enters this organism, the innate immune system provides an immediate, but non-specific response. If pathogens evade this innate response, vertebrates possess a second layer of protection, the adaptive immune system. Here, the immune system adapts its response during an infection to improve its recognition of the pathogen. This improved response is then retained after the pathogen has been eliminated, in the form of an immunological memory, and allows the adaptive immune system to mount faster and stronger attacks each time this pathogen is encountered. According to this, the immune system comprises the innate and the adaptive immune system. Each of these two parts typically contains so called humoral and cellular components.

Immunostimulatory RNA: An immunostimulatory RNA (isRNA) in the context of the invention may typically be an RNA that is able to induce an innate immune response. It usually does not have an open reading frame and thus does not provide a peptide-antigen or immunogen but elicits an immune response e.g. by binding to a specific kind of Toll-like-receptor (TLR) or other suitable receptors. However, of course also mRNAs having an open reading frame and coding for a peptide/protein may induce an innate immune response and, thus, may be immunostimulatory RNAs.

Innate immune system: The innate immune system, also known as non-specific (or unspecific) immune system, typically comprises the cells and mechanisms that defend the host from infection by other organisms in a non-specific manner. This means that the cells of the innate system may recognize and respond to pathogens in a generic way, but unlike the adaptive immune system, it does not confer long-lasting or protective immunity to the host. The innate immune system may be, e.g., activated by ligands of Toll-like receptors (TLRs) or other auxiliary substances such as lipopolysaccharides, TNF-alpha, CD40 ligand, or cytokines, monokines, lymphokines, interleukins or chemokines, IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, IFN-alpha, IFN-beta, IFN-gamma, GM-CSF, G-CSF, M-CSF, LT-beta, TNF-alpha, growth factors, and hGH, a ligand of human Toll-like receptor TLR1, TLR2, TLR3, TLR4, TLR5, TLR6, TLR7, TLR8, TLR9, TLR10, a ligand of murine Toll-like receptor TLR1, TLR2, TLR3, TLR4, TLR5, TLR6, TLR7, TLR8, TLR9, TLR10, TLR11, TLR12 or TLR13, a ligand of a NOD-like receptor, a ligand of a RIG-I like receptor, an immunostimulatory nucleic acid, an immunostimulatory RNA (isRNA), a CpG-DNA, an antibacterial agent, or an anti-viral agent. The pharmaceutical composition according to the present invention may comprise one or more such substances. Typically, a response of the innate immune system includes recruiting immune cells to sites of infection, through the production of chemical factors, including specialized chemical mediators, called cytokines; activation of the complement cascade; identification and removal of foreign substances present in organs, tissues, the blood and lymph, by specialized white blood cells; activation of the adaptive immune system; and/or acting as a physical and chemical barrier to infectious agents.

Cloning site: A cloning site is typically understood to be a segment of a nucleic acid molecule, which is suitable for insertion of a nucleic acid sequence, e.g., a nucleic acid sequence comprising an open reading frame. Insertion may be performed by any molecular biological method known to the one skilled in the art, e.g. by restriction and ligation. A cloning site typically comprises one or more restriction enzyme recognition sites (restriction sites). These one or more restrictions sites may be recognized by restriction enzymes which cleave the DNA at these sites. A cloning site which comprises more than one restriction site may also be termed a multiple cloning site (MCS) or a polylinker.

Nucleic acid molecule: A nucleic acid molecule is a molecule comprising, preferably consisting of nucleic acid components. The term nucleic acid molecule preferably refers to DNA or RNA molecules. It is preferably used synonymous with the term "polynucleotide". Preferably, a nucleic acid molecule is a polymer comprising or consisting of nucleotide monomers which are covalently linked to each other by phosphodiester-bonds of a sugar/phosphate-backbone. The term "nucleic acid molecule" also encompasses modified nucleic acid molecules, such as base-modified, sugar-modified or backbone-modified etc. DNA or RNA molecules.

Open reading frame: An open reading frame (ORF) in the context of the invention may typically be a sequence of several nucleotide triplets which may be translated into a peptide or protein. An open reading frame preferably contains a start codon, i.e. a combination of three subsequent nucleotides coding usually for the amino acid methionine (ATG or AUG), at its 5'-end and a subsequent region which usually exhibits a length which is a multiple of 3 nucleotides. An ORF is preferably terminated by a stop-codon (e.g., TAA, TAG, TGA). Typically, this is the only stop-codon of the open reading frame. Thus, an open reading frame in the context of the present invention is preferably a nucleotide sequence, consisting of a number of nucleotides that may be divided by three, which starts with a start codon (e.g. ATG or AUG) and which preferably terminates with a stop codon (e.g., TAA, TGA, or TAG or UAA, UAG, UGA, respectively). The open reading frame may be isolated or it may be incorporated in a longer nucleic acid sequence, for example in a vector or an mRNA. An open reading frame may also be termed 'protein coding region'.

Peptide: A peptide or polypeptide is typically a polymer of amino acid monomers, linked by peptide bonds. It typically contains less than 50 monomer units. Nevertheless, the term peptide is not a disclaimer for molecules having more than 50 monomer units. Long peptides are also called polypeptides, typically having between 50 and 600 monomeric units.

Pharmaceutically effective amount: A pharmaceutically effective amount in the context of the invention is typically understood to be an amount that is sufficient to induce a pharmaceutical effect, such as an immune response, altering a pathological level of an expressed peptide or protein, or substituting a lacking gene product, e.g., in case of a pathological situation.

Protein A protein typically comprises one or more peptides or polypeptides. A protein is typically folded into 3-dimensional form, which may be required for to protein to exert its biological function.

Poly(A) sequence: A poly(A) sequence, also called poly(A) tail or 3'-poly(A) tail, is typically understood to be a sequence of adenine nucleotides, e.g., of up to about 400 adenine nucleotides, e.g. from about 20 to about 400, preferably from about 50 to about 400, more preferably from about 50 to about 300, even more preferably from about 50 to about 250, most preferably from about 60 to about 250 adenine nucleotides. A poly(A) sequence is typically located at the 3'end of an mRNA. In the context of the present invention, a poly(A) sequence may be located within an mRNA or any other nucleic acid molecule, such as, e.g., in a vector, for example, in a vector serving as template for the generation of an RNA, preferably an mRNA, e.g., by transcription of the vector.

Polyadenylation: Polyadenylation is typically understood to be the addition of a poly(A) sequence to a nucleic acid molecule, such as an RNA molecule, e.g. to a premature mRNA. Polyadenylation may be induced by a so called polyadenylation signal. This signal is preferably located within a stretch of nucleotides at the 3'-end of a nucleic acid molecule, such as an RNA molecule, to be polyadenylated. A polyadenylation signal typically comprises a hexamer consisting of adenine and uracil/thymine nucleotides, preferably the hexamer sequence AAUAAA. Other sequences, preferably hexamer sequences, are also conceivable. Polyadenylation typically occurs during processing of a pre-mRNA (also called premature-mRNA). Typically, RNA maturation (from pre-mRNA to mature mRNA) comprises the step of polyadenylation.

Restriction site: A restriction site, also termed 'restriction enzyme recognition site', is a nucleotide sequence recognized by a restriction enzyme. A restriction site is typically a short, preferably palindromic nucleotide sequence, e.g. a sequence comprising 4 to 8 nucleotides. A restriction site is preferably specifically recognized by a restriction enzyme. The restriction enzyme typically cleaves a nucleotide sequence comprising a restriction site at this site. In a double-stranded nucleotide sequence, such as a double-stranded DNA sequence, the restriction enzyme typically cuts both strands of the nucleotide sequence.

RNA, mRNA: RNA is the usual abbreviation for ribonucleic-acid. It is a nucleic acid molecule, i.e. a polymer consisting of nucleotides. These nucleotides are usually adenosine-monophosphate, uridine-monophosphate, guanosine-monophosphate and cytidine-monophosphate monomers which are connected to each other along a so-called backbone. The backbone is formed by phosphodiester bonds between the sugar, i.e. ribose, of a first and a phosphate moiety of a second, adjacent monomer. The specific succession of the monomers is called the RNA-sequence. Usually RNA may be obtainable by transcription of a DNA-sequence, e.g., inside a cell. In eukaryotic cells, transcription is typically performed inside the nucleus or the mitochondria. In vivo, transcription of DNA usually results in the so-called premature RNA which has to be processed into so-called messenger-RNA, usually abbreviated as mRNA. Processing of the premature RNA, e.g. in eukaryotic organisms, comprises a variety of different posttranscriptional-modifications such as splicing, 5'-capping, polyadenylation, export from the nucleus or the mitochondria and the like. The sum of these processes is also called maturation of RNA. The mature messenger RNA usually provides the nucleotide sequence that may be translated into an amino acid sequence of a particular peptide or protein. Typically, a mature mRNA comprises a 5'-cap, a 5'UTR, an open reading frame, a 3'UTR and a poly(A) sequence. Aside from messenger RNA, several non-coding types of RNA exist which may be involved in regulation of transcription and/or translation.

Sequence of a nucleic acid molecule: The sequence of a nucleic acid molecule is typically understood to be the particular and individual order, i.e. the succession of its nucleotides. The sequence of a protein or peptide is typically understood to be the order, i.e. the succession of its amino acids.

Sequence identity: Two or more sequences are identical if they exhibit the same length and order of nucleotides or amino acids. The percentage of identity typically describes the extent to which two sequences are identical, i.e. it typically describes the percentage of nucleotides that correspond in their sequence position with identical nucleotides of a reference-sequence. For determination of the degree of identity, the sequences to be compared are considered to exhibit the same length, i.e. the length of the longest sequence of the sequences to be compared. This means that a first sequence consisting of 8 nucleotides is 80% identical to a second sequence consisting of 10 nucleotides comprising the first sequence. In other words, in the context of the present invention, identity of sequences preferably relates to the percentage of nucleotides of a sequence which have the same position in two or more sequences having the same length. Gaps are usually regarded as non-identical positions, irrespective of their actual position in an alignment.

Stabilized nucleic acid molecule: A stabilized nucleic acid molecule is a nucleic acid molecule, preferably a DNA or RNA molecule that is modified such, that it is more stable to disintegration or degradation, e.g., by environmental factors or enzymatic digest, such as by an exo- or endonuclease degradation, than the nucleic acid molecule without the modification. Preferably, a stabilized nucleic acid molecule in the context of the present invention is stabilized in a cell, such as a prokaryotic or eukaryotic cell, preferably in a mammalian cell, such as a human cell. The stabilization effect may also be exerted outside of cells, e.g. in a buffer solution etc., for example, in a manufacturing process for a pharmaceutical composition comprising the stabilized nucleic acid molecule.

Transfection: The term 'transfection' refers to the introduction of nucleic acid molecules, such as DNA or RNA (e.g. mRNA) molecules, into cells, preferably into eukaryotic cells. In the context of the present invention, the term 'transfection' encompasses any method known to the skilled person for introducing nucleic acid molecules into cells, preferably into eukaryotic cells, such as into mammalian cells. Such methods encompass, for example, electroporation, lipofection, e.g. based on cationic lipids and/or liposomes, calcium phosphate precipitation, nanoparticle based transfection, virus based transfection, or transfection based on cationic polymers, such as DEAE-dextran or polyethylenimine etc. Preferably, the introduction is non-viral.

Vaccine: A vaccine is typically understood to be a prophylactic or therapeutic material providing at least one antigen, preferably an immunogen. The antigen or immunogen may be derived from any material that is suitable for vaccination. For example, the antigen or immunogen may be derived from a pathogen, such as from bacteria or virus particles etc., or from a tumor or cancerous tissue. The antigen or immunogen stimulates the body's adaptive immune system to provide an adaptive immune response.

Vector: The term 'vector' refers to a nucleic acid molecule, preferably to an artificial nucleic acid molecule. A vector in the context of the present invention is suitable for incorporating or harboring a desired nucleic acid sequence, such as a nucleic acid sequence comprising an open reading frame. Such vectors may be storage vectors, expression vectors, cloning vectors, transfer vectors etc. A storage vector is a vector which allows the convenient storage of a nucleic acid molecule, for example, of an mRNA molecule. Thus, the vector may comprise a sequence corresponding, e.g., to a desired mRNA sequence or a part thereof, such as a sequence corresponding to the open reading frame and the 3'UTR of an mRNA. An expression vector may be used for production of expression products such as RNA, e.g. mRNA, or peptides, polypeptides or proteins. For example, an expression vector may comprise sequences needed for transcription of a sequence stretch of the vector, such as a promoter sequence, e.g. an RNA promoter sequence. A cloning vector is typically a vector that contains a cloning site, which may be used to incorporate nucleic acid sequences into the vector. A cloning vector may be, e.g., a plasmid vector or a bacteriophage vector. A transfer vector may be a vector which is suitable for transferring nucleic acid molecules into cells or organisms, for example, viral vectors. A vector in the context of the present invention may be, e.g., an RNA vector or a DNA vector. Preferably, a vector is a DNA molecule. Preferably, a vector in the sense of the present application comprises a cloning site, a selection marker, such as an antibiotic resistance factor, and a sequence suitable for multiplication of the vector, such as an origin of replication. Preferably, a vector in the context of the present application is a plasmid vector.

Vehicle: A vehicle is typically understood to be a material that is suitable for storing, transporting, and/or administering a compound, such as a pharmaceutically active compound. For example, it may be a physiologically acceptable liquid which is suitable for storing, transporting, and/or administering a pharmaceutically active compound.

3'-untranslated region (3'UTR): A 3'UTR is typically the part of an mRNA which is located between the protein coding region (i.e. the open reading frame) and the poly(A) sequence of the mRNA. A 3'UTR of the mRNA is not translated into an amino acid sequence. The 3'UTR sequence is generally encoded by the gene which is transcribed into the respective mRNA during the gene expression process. The genomic sequence is first transcribed into pre-mature mRNA, which comprises optional introns. The pre-mature mRNA is then further processed into mature mRNA in a maturation process. This maturation process comprises the steps of 5'capping, splicing the pre-mature mRNA to excise optional introns and modifications of the 3'-end, such as polyadenylation of the 3'-end of the pre-mature mRNA and optional endo- or exonuclease cleavages etc. In the context of the present invention, a 3'UTR corresponds to the sequence of a mature mRNA which is located 3' to the stop codon of the protein coding region, preferably immediately 3' to the stop codon of the protein coding region, and which extends to the 5'-side of the poly(A) sequence, preferably to the nucleotide immediately 5' to the poly(A) sequence. The term "corresponds to" means that the 3'UTR sequence may be an RNA sequence, such as in the mRNA sequence used for defining the 3'UTR sequence, or a DNA sequence which corresponds to such RNA sequence. In the context of the present invention, the term "a 3'UTR of a gene", such as "a 3'UTR of an albumin gene", is the sequence which corresponds to the 3'UTR of the mature mRNA derived from this gene, i.e. the mRNA obtained by transcription of the gene and maturation of the pre-mature mRNA. The term "3'UTR of a gene" encompasses the DNA sequence and the RNA sequence of the 3'UTR.

5'-untranslated region (5'UTR): A 5'UTR is typically understood to be a particular section of messenger RNA (mRNA). It is located 5' of the open reading frame of the mRNA. Typically, the 5'UTR starts with the transcriptional start site and ends one nucleotide before the start codon of the open reading frame. The 5'UTR may comprise elements for controlling gene expression, also called regulatory elements. Such regulatory elements may be, for example, ribosomal binding sites or a 5'-Terminal Oligopyrimidine Tract. The 5'UTR may be posttranscriptionally modified, for example by addition of a 5'-cap. In the context of the present invention, a 5'UTR corresponds to the sequence of a mature mRNA which is located between the 5'cap and the start codon. Preferably, the 5'UTR corresponds to the sequence which extends from a nucleotide located 3' to the 5'-cap, preferably from the nucleotide located immediately 3' to the 5'cap, to a nucleotide located 5' to the start codon of the protein coding region, preferably to the nucleotide located immediately 5' to the start codon of the protein coding region. The nucleotide located immediately 3' to the 5'cap of a mature mRNA typically corresponds to the transcriptional start site. The term "corresponds to" means that the 5'UTR sequence may be an RNA sequence, such as in the mRNA sequence used for defining the 5'UTR sequence, or a DNA sequence which corresponds to such RNA sequence. In the context of the present invention, the term "a 5'UTR of a gene", such as "a 5'UTR of a TOP gene", is the sequence which corresponds to the 5'UTR of the mature mRNA derived from this gene, i.e. the mRNA obtained by transcription of the gene and maturation of the pre-mature mRNA. The term "5'UTR of a gene" encompasses the DNA sequence and the RNA sequence of the 5'UTR.

5'Terminal Oligopyrimidine Tract (TOP): The 5'terminal oligopyrimidine tract (TOP) is typically a stretch of pyrimidine nucleotides located at the 5' terminal region of a nucleic acid molecule, such as the 5' terminal region of certain mRNA molecules or the 5' terminal region of a functional entity, e.g. the transcribed region, of certain genes. The sequence starts with a cytidine, which usually corresponds to the transcriptional start site, and is followed by a stretch of usually about 3 to 30 pyrimidine nucleotides. For example, the TOP may comprise 3, 4, 5, 6, 7, 8, 9, 10, 11, 12, 13, 14, 15, 16, 17, 18, 19, 20, 21, 22, 23, 24, 25, 26, 27, 28, 29, 30 or even more nucleotides. The pyrimidine stretch and thus the 5' TOP ends one nucleotide 5' to the first purine nucleotide located downstream of the TOP. Messenger RNA that contains a 5'terminal oligopyrimidine tract is often referred to as 5' TOP mRNA. Accordingly, genes that provide such messenger RNAs are referred to as TOP genes. TOP sequences have, for example, been found in genes and mRNAs encoding peptide elongation factors and ribosomal proteins.

TOP motif: In the context of the present invention, a TOP motif is a nucleic acid sequence which corresponds to a 5'TOP as defined above. Thus, a TOP motif in the context of the present invention is preferably a stretch of pyrimidine nucleotides having a length of 3-30 nucleotides. Preferably, the TOP-motif consists of at least 3 pyrimidine nucleotides, preferably at least 4 pyrimidine nucleotides, preferably at least 5 pyrimidine nucleotides, more preferably at least 6 nucleotides, more preferably at least 7 nucleotides, most preferably at least 8 pyrimidine nucleotides, wherein the stretch of pyrimidine nucleotides preferably starts at its 5'end with a cytosine nucleotide. In TOP genes and TOP mRNAs, the TOP-motif preferably starts at its 5'end with the transcriptional start site and ends one nucleotide 5' to the first purin residue in said gene or mRNA. A TOP motif in the sense of the present invention is preferably located at the 5'end of a sequence which represents a 5'UTR or at the 5'end of a sequence which codes for a 5'UTR. Thus, preferably, a stretch of 3 or more pyrimidine nucleotides is called "TOP motif" in the sense of the present invention if this stretch is located at the 5'end of a respective sequence, such as the artificial nucleic acid molecule according to the present invention, the 5'UTR element of the artificial nucleic acid molecule according to the present invention, or the nucleic acid sequence which is derived from the 5'UTR of a TOP gene as described herein. In other words, a stretch of 3 or more pyrimidine nucleotides which is not located at the 5'-end of a 5'UTR or a 5'UTR element but anywhere within a 5'UTR or a 5'UTR element is preferably not referred to as "TOP motif".

TOP gene: TOP genes are typically characterised by the presence of a 5' terminal oligopyrimidine tract. Furthermore, most TOP genes are characterized by a growth-associated translational regulation. However, also TOP genes with a tissue specific translational regulation are known. As defined above, the 5'UTR of a TOP gene corresponds to the sequence of a 5'UTR of a mature mRNA derived from a TOP gene, which preferably extends from the nucleotide located 3' to the 5'cap to the nucleotide located 5' to the start codon. A 5'UTR of a TOP gene typically does not comprise any start codons, preferably no upstream AUGs (uAUGs) or upstream open reading frames (uORFs). Therein, upstream AUGs and upstream open reading frames are typically understood to be AUGs and open reading frames that occur 5' of the start codon (AUG) of the open reading frame that should be translated. The 5'UTRs of TOP genes are generally rather short. The lengths of 5'UTRs of TOP genes may vary between 20 nucleotides up to 500 nucleotides, and are typically less than about 200 nucleotides, preferably less than about 150 nucleotides, more preferably less than about 100 nucleotides. Exemplary 5'UTRs of TOP genes in the sense of the present invention are the nucleic acid sequences extending from the nucleotide at position 5 to the nucleotide located immediately 5' to the start codon (e.g. the ATG) in the sequences according to SEQ ID NOs. 1-1363, 1435, 1461 and 1462.

In a first aspect, the present invention relates to an artificial nucleic acid molecule comprising:
a. at least one 5'-untranslated region element (5'UTR element) which comprises or consists of a nucleic acid sequence which is derived from the 5'UTR of a TOP gene or which is derived from a variant of the 5'UTR of a TOP gene; and
b. at least one open reading frame (ORF).

Preferably, the artificial nucleic acid molecule further comprises:
c. at least one histone stem-loop.

Such an artificial nucleic acid molecule may be DNA or RNA. In case the artificial nucleic acid molecule is DNA it may be used for providing RNA, preferably an mRNA with a corresponding sequence as is described further below. The inventive artificial nucleic acid molecule is particularly useful in gene therapy and genetic vaccination because it may provide increased and/or prolonged protein production of the protein encoded by the open reading frame.

In this context, the term '5'UTR element' preferably refers to a nucleic acid sequence which represents a 5'UTR of an artificial nucleic acid sequence, such as an artificial mRNA, or which codes for a 5'UTR of an artificial nucleic acid molecule. Thus, preferably, a 5'UTR element may be the 5'UTR of an mRNA, preferably of an artificial mRNA, or it may be the transcription template for a 5'UTR of an mRNA. Thus, a 5'UTR element preferably is a nucleic acid sequence which corresponds to the 5'UTR of an mRNA, preferably to the 5'UTR of an artificial mRNA, such as an mRNA obtained by transcription of a genetically engineered vector construct. Preferably, a 5'UTR element in the sense of the present invention functions as a 5'UTR or codes for a nucleotide sequence that fulfils the function of a 5'UTR. The term '5'UTR element' furthermore refers to a fragment or part of a 5'UTR of an artificial nucleic acid sequence, such as an artificial mRNA, or which codes for a part or fragment of a 5'UTR of an artificial nucleic acid molecule. This means that the 5'UTR element in the sense of the present invention may be comprised in the 5'UTR of an artificial nucleic acid sequence, such as an artificial mRNA, or which codes for a 5'UTR of an artificial nucleic acid molecule.

According to the invention, the 5'UTR element comprises or consists of a nucleic acid sequence that is derived from the 5'UTR of a TOP gene or from a variant of the 5'UTR of a TOP gene.

The term 'a nucleic acid sequence which is derived from the 5'UTR of a TOP gene' preferably refers to a nucleic acid sequence which is based on the 5'UTR sequence of a TOP gene or on a fragment thereof. This term includes sequences corresponding to the entire 5'UTR sequence, i.e. the full length 5'UTR sequence of a TOP gene, and sequences corresponding to a fragment of the 5'UTR sequence of a TOP gene. Preferably, a fragment of a 5'UTR of a TOP gene consists of a continuous stretch of nucleotides corresponding to a continuous stretch of nucleotides in the full-length 5'UTR of a TOP gene, which represents at least 20%, preferably at least 30%, more preferably at least 40%, more preferably at least 50%, even more preferably at least 60%, even more preferably at least 70%, even more preferably at least 80%, and most preferably at least 90% of the full-length 5'UTR of a TOP gene. Such a fragment, in the sense of the present invention, is preferably a functional fragment as described herein. A particularly preferred fragment of a 5'UTR of a TOP gene is a 5'UTR of a TOP gene lacking the 5'TOP motif. The term '5'UTR of a TOP gene' preferably refers to the 5'UTR of a naturally occurring TOP gene.

The terms 'variant of the 5'UTR of a TOP gene' and 'variant thereof' in the context of a 5'UTR of a TOP gene refers to a variant of the 5'UTR of a naturally occurring TOP gene, preferably to a variant of the 5'UTR of a vertebrate TOP gene, preferably to a variant of the 3'UTR of a mammalian TOP gene, more preferably to a variant of the 3'UTR of a human TOP gene. Such variant may be a modified 5'UTR of a TOP gene. For example, a variant 5'UTR may exhibit one or more nucleotide deletions, insertions, additions and/or substitutions compared to the naturally occurring 5'UTR from which the variant is derived. Preferably, a variant of a 5'UTR of a TOP gene is at least 40%, preferably at least 50%, more preferably at least 60%, more preferably at least 70%, even more preferably at least 80%, even more preferably at least 90%, most preferably at least 95% identical to the naturally occurring 5'UTR the variant is derived from. Preferably, the variant is a functional variant as described herein.

The term "a nucleic acid sequence that is derived from a variant of the 5'UTR of a TOP gene" preferably refers to a nucleic acid sequence which is based on a variant of a 5'UTR sequence of a TOP gene or on a fragment thereof. This term includes sequences corresponding to the entire variant 5'UTR sequence, i.e. the full length variant 5'UTR sequence of a TOP gene, and sequences corresponding to a fragment of the variant 5'UTR sequence of a TOP gene. Preferably, a fragment of a variant of the 5'UTR of a TOP gene consists of a continuous stretch of nucleotides corresponding to a continuous stretch of nucleotides in the full-length variant 5'UTR of a TOP gene, which represents at least 20%, preferably at least 30%, more preferably at least 40%, more preferably at least 50%, even more preferably at least 60%, even more preferably at least 70%, even more preferably at least 80%, and most preferably at least 90% of the full-length variant 5'UTR of a TOP gene. Such a fragment of a variant, in the sense of the present invention, is preferably a functional fragment as described herein.

Thus, the 5'UTR element of the artificial nucleic acid molecule may comprise or consist of a fragment of the 5'UTR of a TOP gene or of a fragment of a variant of the 5'UTR of a TOP gene or may comprise or consist of the entire 5'UTR of a TOP gene or may comprise or consist of a variant of the 5'UTR of a TOP gene.

The 5'UTR element is preferably suitable for increasing protein production from the artificial nucleic acid molecule.

Preferably, the at least one 5'UTR element is functionally linked to the ORF. This means preferably that the 5'UTR element is associated with the ORF such that it may exert a function, such as a protein production increasing function for the protein encoded by the ORF or a stabilizing function on the artificial nucleic acid molecule. Preferably, the 5'UTR element and the ORF are associated in 5'→3' direction. Thus, preferably, the artificial nucleic acid molecule comprises the structure 5'-5'UTR element-(optional)linker-ORF-3', wherein the linker may be present or absent. For example, the linker may be one or more nucleotides, such as a stretch of 1-50 or 1-20 nucleotides, e.g., comprising or consisting of one or more restriction enzyme recognition sites (restriction sites).

Preferably, the 5'UTR element and the at least one open reading frame are heterologous. The term 'heterologous' in this context means that the open reading frame and the 5'UTR element are not occurring naturally (in nature) in this combination. Preferably, the 5'UTR element is derived from a different gene than the open reading frame. For example, the ORF may be derived from a different gene than the 5'UTR element, e.g. encoding a different protein or the same protein but of a different species etc. For example, the ORF does not encode the protein which is encoded by the gene from which the 5'UTR element is derived.

In a preferred embodiment, the 5'UTR element, preferably the artificial nucleic acid molecule, does not comprise a complete TOP-motif or 5'TOP sequence. Thus, preferably, the 5'UTR element, preferably the artificial nucleic acid molecule, does not comprise the complete TOP-motif of the TOP gene from which the nucleic acid sequence of the 5'UTR element is derived. For example, the 5'UTR element or the artificial nucleic acid molecule according to the present invention may comprise 1, 2, 3, 4, 5, 6, 7, 8, 9, 10 or more pyrimidine residues of the TOP-motif or 5'TOP, preferably 1, 2, 3, 4, 5, 6, 7, 8, 9, 10 or more pyrimidine residues of the TOP-motif located at the 3'side of the TOP-motif or 5'TOP. For example, the 5'UTR element may comprise or consist of a nucleic acid sequence which starts at its 5'end with a pyrimidine residue that corresponds to residue 2, 3, 4, 5, 6, 7, 8, 9, 10 etc. of the TOP-motif or 5'TOP of the TOP gene from which the nucleic acid sequence of the 5'UTR element is derived.

It is particularly preferred that the 5'UTR element, preferably the artificial nucleic acid molecule according to the present invention, does not comprise a TOP-motif or 5'TOP. For example, the nucleic acid sequence of the 5'UTR element which is derived from a 5'UTR of a TOP gene starts at its 5'-end with a nucleotide located at position 1, 2, 3, 4, 5, 6, 7, 8, 9 or 10 downstream of the 5'terminal oligopyrimidine tract (TOP) of the 5'UTR of a TOP gene. Position 1 downstream of the 5'terminal oligopyrimidine tract (TOP) is the first purine based nucleotide 3' of the TOP-motif or the 5'TOP. Accordingly, position 1 downstream of the 5'terminal oligopyrimidine tract is the first nucleotide following the 3'-end of the 5'terminal oligopyrimidine tract in 5'-3'-direction. Likewise, position 2 downstream of the 5'TOP is the second nucleotide following the end of the 5'terminal oligopyrimidine tract, position 3 the third nucleotide and so on.

Therefore, the 5'UTR element preferably starts 5, 10, 15, 20, 25, 30, 40 or 50 nucleotides downstream of the transcriptional start site of the 5'UTR of a TOP gene.

In some embodiments, the nucleic acid sequence of the 5'UTR element which is derived from a 5'UTR of a TOP gene terminates at its 3'-end with a nucleotide located at position 1, 2, 3, 4, 5, 6, 7, 8, 9 or 10 upstream of the start codon (e.g. A(U/T)G) of the gene or mRNA it is derived from. Thus, the 5'UTR element does not comprise any part of the protein coding region. Thus, preferably, the only protein coding part of the inventive artificial nucleic acid molecule is provided by the open reading frame. However, the open reading frame is preferably derived—as said above—from a gene that is different to the gene the 5'UTR element is derived from.

It is particularly preferred that the 5'UTR element does not comprise a start codon, such as the nucleotide sequence A(U/T)G. Thus, preferably, the artificial nucleic acid molecule will not comprise any upstream AUGs (or upstream ATGs in case it is a DNA molecule). In other words, in some embodiments, it may be preferred that the AUG or ATG, respectively, of the open reading frame is the only start codon of the artificial nucleic acid molecule.

Additionally, it is preferred that the 5'UTR element does not comprise an open reading frame. Thus, preferably, the artificial nucleic acid molecule will not comprise any upstream open reading frames.

The nucleic acid sequence which is derived from the 5'UTR of a TOP gene is derived from a eukaryotic TOP gene, preferably a plant or animal TOP gene, more preferably a chordate TOP gene, even more preferably a vertebrate TOP gene, most preferably a mammalian TOP gene, such as a human or mouse TOP gene.

Preferably, the artificial nucleic acid molecule according to the present invention comprises a 5'UTR element which comprises or consists of a nucleic acid sequence which is derived from the 5'UTR of a TOP gene or which is derived from a variant of the 5'UTR of a TOP gene, wherein the TOP gene is a plant or animal TOP gene, more preferably a chordate TOP gene, even more preferably a vertebrate TOP gene, most preferably a mammalian TOP gene, such as a human or mouse TOP gene and which optionally does not comprise the nucleotide sequence A(U/T)G and optionally does not comprise an open reading frame; at least one open reading frame (ORF); and optionally at least one histone-stem loop; wherein optionally the 5'UTR element does not comprise a TOP motif and wherein optionally the 5'UTR element starts at its 5'-end with a nucleotide located at position 1, 2, 3, 4, 5, 6, 7, 8, 9 or 10 downstream of the 5'terminal oligopyrimidine tract (TOP) of the 5'UTR of a TOP gene and wherein further optionally the 5'UTR element which is derived from a 5'UTR of a TOP gene terminates at its 3'-end with a nucleotide located at position 1, 2, 3, 4, 5, 6, 7, 8, 9 or 10 upstream of the start codon (A(U/T)G) of the gene or mRNA it is derived from.

For example, the 5'UTR element comprises or consists of a nucleic acid sequence which is derived from a nucleic acid sequence selected from the group consisting of SEQ ID NOs. 1-1363, SEQ ID NO. 1435, SEQ ID NO. 1461 or SEQ ID NO. 1462, from the homologs of SEQ ID NOs. 1-1363, SEQ ID NO. 1435, SEQ ID NO. 1461 or SEQ ID NO. 1462, from a variant thereof, or a corresponding RNA sequence. The term "homologs of SEQ ID NOs. 1-1363, SEQ ID NO. 1435, SEQ ID NO. 1461 or SEQ ID NO. 1462," refers to sequences of other species than *Homo sapiens* (human) or *Mus musculus* (mouse), which are homologous to the sequences according to SEQ ID NOs. 1-1363, SEQ ID NO. 1435, SEQ ID NO. 1461 or SEQ ID NO. 1462. For example, SEQ ID NO. 1 relates to a sequence comprising the 5'UTR of *Homo sapiens* alpha 2 macroglobulin (A2M). A homolog of SEQ ID NO. 1 in the context of the present invention is any such sequence derived from an alpha 2 macroglobulin (A2M) gene or mRNA of another species than *Homo sapiens* (human), such as any vertebrate, preferably any mammalian alpha 2 macroglobulin (A2M) gene other than the human alpha 2 macroglobulin (A2M) gene, such as a mouse, rat, rabbit, monkey etc. alpha 2 macroglobulin (A2M) gene.

In a preferred embodiment, the 5'UTR element comprises or consists of a nucleic acid sequence which is derived from a nucleic acid sequence extending from nucleotide position 5 (i.e. the nucleotide that is located at position 5 in the sequence) to the nucleotide position immediately 5' to the start codon (located at the 3' end of the sequences), e.g. the nucleotide position immediately 5' to the ATG sequence, of a nucleic acid sequence selected from SEQ ID NOs. 1-1363, SEQ ID NO. 1435, SEQ ID NO. 1461 or SEQ ID NO. 1462, from the homologs of SEQ ID NOs. 1-1363, SEQ ID NO. 1435, SEQ ID NO. 1461 or SEQ ID NO. 1462, from a variant thereof, or a corresponding RNA sequence. It is particularly preferred that the 5' UTR element is derived from a nucleic acid sequence extending from the nucleotide position immediately 3' to the 5'-TOP to the nucleotide position immediately 5' to the start codon (located at the 3' end of the sequences), e.g. the nucleotide position immediately 5' to the ATG sequence, of a nucleic acid sequence selected from SEQ ID NOs. 1-1363, SEQ ID NO. 1435, SEQ ID NO. 1461 or SEQ ID NO. 1462, from the homologs of SEQ ID NOs. 1-1363, SEQ ID NO. 1435, SEQ ID NO. 1461 or SEQ ID NO. 1462, from a variant thereof, or a corresponding RNA sequence.

In a preferred embodiment, the 5'UTR element comprises or consists of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to a nucleic acid sequence extending from nucleotide position 5 to the nucleotide position immediately 5' to the start codon (located at the 3' end of the sequences), e.g. the nucleotide position immediately 5' to the ATG sequence of a nucleic acid sequence, selected from SEQ ID NOs. 1-1363, SEQ ID NO. 1435, SEQ ID NO. 1461 or SEQ ID NO. 1462, or a corresponding RNA sequence, or wherein the at least one 5'UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to a nucleic acid sequence extending from nucleotide position 5 to the nucleotide position immediately 5' to the start codon (located at the 3' end of the sequences), e.g. the nucleotide position immediately 5' to the ATG sequence of a nucleic acid sequence, selected from SEQ ID NOs. 1-1363, SEQ ID NO. 1435, SEQ ID NO. 1461 or SEQ ID NO. 1462, or a corresponding RNA sequence, wherein, preferably, the fragment is as described above, i.e. being a continuous stretch of nucleotides representing at least 20% etc. of the full-length 5'UTR the fragment is derived from.

Preferably, the 5'UTR element comprises or consists of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to a nucleic acid sequence extending from the nucleotide position immediately 3' to the 5'TOP to the nucleotide position immediately 5' to the start codon (located at the 3' end of the sequences), e.g. the nucleotide position immediately 5' to the ATG sequence, of a nucleic acid sequence selected from SEQ ID NOs. 1-1363, SEQ ID NO. 1435, SEQ ID NO. 1461 or SEQ ID NO. 1462, or a corresponding RNA sequence, or wherein the at least one 5'UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to a nucleic acid sequence extending from the nucleotide position immediately 3' to the 5'TOP to the nucleotide position immediately 5' to the start codon (located at the 3' end of the sequences), e.g. the nucleotide position immediately 5' to the ATG sequence, of a nucleic acid sequence selected from SEQ ID NOs. 1-1363, SEQ ID NO. 1435, SEQ ID NO. 1461 or SEQ ID NO. 1462, or a corresponding RNA sequence, wherein, preferably, the fragment is as described above, i.e. being a continuous stretch of nucleotides representing at least 20% etc. of the full-length 5'UTR the fragment is derived from.

Preferably, the above defined fragments and variants (e.g. exhibiting at least 40% identity) of the sequences according to SEQ ID NOs. 1-1363, SEQ ID NO. 1435, SEQ ID NO. 1461 or SEQ ID NO. 1462, are functional fragments and variants as described herein.

Furthermore, the artificial nucleic acid molecule according to the present invention may comprise more than one 5'UTR elements as described above. For example, the artificial nucleic acid molecule according to the present invention may comprise one, two, three, four or more 5'UTR elements, wherein the individual 5'UTR elements may be the same or they may be different. For example, the artificial nucleic acid molecule according to the present invention may comprise two essentially identical 5'UTR elements as described above, e.g. two 5'UTR elements comprising or consisting of a nucleic acid sequence which is derived from a nucleic acid sequence selected from the group consisting of SEQ ID NOs. 1-1363, SEQ ID NO. 1435, SEQ ID NO. 1461 or SEQ ID NO. 1462, from the homologs of SEQ ID NOs. 1-1363, SEQ ID NO. 1435, SEQ ID NO. 1461 or SEQ ID NO. 1462, from a variant thereof, or a corresponding RNA sequence or from functional variants thereof, functional fragments thereof, or functional variant fragments thereof as described above.

In a particularly preferred embodiment, the 5'UTR element comprises or consists of a nucleic acid sequence which is derived from a 5'UTR of a TOP gene encoding a ribosomal protein or from a variant of a 5'UTR of a TOP gene encoding a ribosomal protein. Particularly preferred 5'UTR elements comprise or consist of a nucleic acid sequence which are derived from a 5' UTR of a TOP gene coding for a ribosomal protein selected from RPSA, RPS2, RPS3, RPS3A, RPS4, RPS5, RPS6, RPS7, RPS8, RPS9, RPS10, RPS11, RPS12, RPS13, RPS14, RPS15, RPS15A, RPS16, RPS17, RPS18, RPS19, RPS20, RPS21, RPS23, RPS24, RPS25, RPS26, RPS27, RPS27A, RPS28, RPS29, RPS30, RPL3, RPL4, RPL5, RPL6, RPL7, RPL7A, RPL8, RPL9, RPL10, RPL10A, RPL11, RPL12, RPL13, RPL13A, RPL14, RPL15, RPL17, RPL18, RPL18A, RPL19, RPL21, RPL22, RPL23, RPL23A, RPL24, RPL26, RPL27, RPL27A, RPL28, RPL29, RPL30, RPL31, RPL32, RPL34, RPL35, RPL35A, RPL36, RPL36A, RPL37, RPL37A, RPL38, RPL39, RPL40, RPL41, RPLP0, RPLP1, RPLP2, RPLP3, UBA52. Particularly preferred are nucleic acid sequences which are derived from a 5' UTR of TOP genes vertebrate coding for ribosomal proteins, such as mammalian ribosomal proteins e.g. human or mouse ribosomal proteins.

For example, the 5'UTR element comprises or consists of a nucleic acid sequence which is derived from a 5'UTR of a nucleic acid sequence according to any of SEQ ID NOs: 170, 232, 244, 259, 1284, 1285, 1286, 1287, 1288, 1289, 1290, 1291, 1292, 1293, 1294, 1295, 1296, 1297, 1298, 1299, 1300, 1301, 1302, 1303, 1304, 1305, 1306, 1307, 1308, 1309, 1310, 1311, 1312, 1313, 1314, 1315, 1316, 1317, 1318, 1319, 1320, 1321, 1322, 1323, 1324, 1325, 1326, 1327, 1328, 1329, 1330, 1331, 1332, 1333, 1334, 1335, 1336, 1337, 1338, 1339, 1340, 1341, 1342, 1343, 1344, 1346, 1347, 1348, 1349, 1350, 1351, 1352, 1353, 1354, 1355, 1356, 1357, 1358, 1359, or 1360; a corresponding RNA sequence, a homolog thereof, or a variant thereof as described herein, preferably lacking the 5'TOP motif. As described above, the sequence extending from position 5 to the nucleotide immediately 5' to the ATG (which is located at the 3'end of the sequences) corresponds to the 5'UTR of said sequences.

Preferably, the 5'UTR element comprises or consists of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the 5'UTR of a nucleic acid sequence according to any of SEQ ID NOs: 170, 232, 244, 259, 1284, 1285, 1286, 1287, 1288, 1289, 1290, 1291, 1292, 1293, 1294, 1295, 1296, 1297, 1298, 1299, 1300, 1301, 1302, 1303, 1304, 1305, 1306, 1307, 1308, 1309, 1310, 1311, 1312, 1313, 1314, 1315, 1316, 1317, 1318, 1319, 1320, 1321, 1322, 1323, 1324, 1325, 1326, 1327, 1328, 1329, 1330, 1331, 1332, 1333, 1334, 1335, 1336, 1337, 1338, 1339, 1340, 1341, 1342, 1343, 1344, 1346, 1347, 1348, 1349, 1350, 1351, 1352, 1353, 1354, 1355, 1356, 1357, 1358, 1359, or 1360; or a corresponding RNA sequence, preferably lacking the 5'TOP motif, or wherein the at least one 5'UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the 5'UTR of a nucleic acid sequence according to SEQ ID NOs: 170, 232, 244, 259, 1284, 1285, 1286, 1287, 1288, 1289, 1290, 1291, 1292, 1293, 1294, 1295, 1296, 1297, 1298, 1299, 1300, 1301, 1302, 1303, 1304, 1305, 1306, 1307, 1308, 1309, 1310, 1311, 1312, 1313, 1314, 1315, 1316, 1317, 1318, 1319, 1320, 1321, 1322, 1323, 1324, 1325, 1326, 1327, 1328, 1329, 1330, 1331, 1332, 1333, 1334, 1335, 1336, 1337, 1338, 1339, 1340, 1341, 1342, 1343, 1344, 1346, 1347, 1348, 1349, 1350, 1351, 1352, 1353, 1354, 1355, 1356, 1357, 1358, 1359, or 1360; or a corresponding RNA sequence, wherein, preferably, the fragment is as described above, i.e. being a continuous stretch of nucleotides representing at least 20% etc. of the full-length 5'UTR, preferably lacking the 5'TOP motif. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

Preferably, the 5'UTR element comprises or consists of a nucleic acid sequence which is derived from a 5'UTR of a TOP gene encoding a ribosomal Large protein (RPL) or from a variant of a 5'UTR of a TOP gene encoding a ribosomal Large protein (RPL). For example, the 5'UTR element comprises or consists of a nucleic acid sequence which is derived from a 5'UTR of a nucleic acid sequence according to any of SEQ ID NOs: 67, 259, 1284-1318, 1344, 1346, 1348-1354, 1357, 1461 and 1462, a corresponding RNA sequence, a homolog thereof, or a variant thereof as described herein, preferably lacking the 5'TOP motif.

Preferably, the 5'UTR element comprises or consists of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the 5'UTR of a nucleic acid sequence according to any of SEQ ID NOs. 67, 259, 1284-1318, 1344, 1346, 1348-1354, 1357, and 1358 or a corresponding RNA sequence, preferably lacking the 5'TOP motif, or wherein the at least one 5'UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the 5′UTR of a nucleic acid sequence according to SEQ ID NOs: 67, 259, 1284-1318, 1344, 1346, 1348-1354, 1357, 1461 and 1462 or a corresponding RNA sequence, wherein, preferably, the fragment is as described above, i.e. being a continuous stretch of nucleotides representing at least 20% etc. of the full-length 5′UTR, preferably lacking the 5′TOP motif. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

In a particularly preferred embodiment, the 5′UTR element comprises or consists of a nucleic acid sequence which is derived from the 5′UTR of a ribosomal protein Large 32 gene (RPL32), a ribosomal protein Large 35 gene (RPL35), a ribosomal protein Large 21 gene (RPL21), an ATP synthase, H+ transporting, mitochondrial F1 complex, alpha subunit 1, cardiac muscle (ATP5A1) gene, an hydroxysteroid (17-beta) dehydrogenase 4 gene (HSD1784), an androgen-induced 1 gene (AIG1), cytochrome c oxidase subunit VIc gene (COX6C), or a N-acylsphingosine amidohydrolase (acid ceramidase) 1 gene (ASAH1) or from a variant thereof, preferably from a vertebrate ribosomal protein Large 32 gene (RPL32), a vertebrate ribosomal protein Large 35 gene (RPL35), a vertebrate ribosomal protein Large 21 gene (RPL21), a vertebrate ATP synthase, H+ transporting, mitochondrial F1 complex, alpha subunit 1, cardiac muscle (ATP5A1) gene, a vertebrate hydroxysteroid (17-beta) dehydrogenase 4 gene (HSD1784), a vertebrate androgen-induced 1 gene (AIG1), a vertebrate cytochrome c oxidase subunit VIc gene (COX6C), or a vertebrate N-acyl-sphingosine amidohydrolase (acid ceramidase) 1 gene (ASAH1) or from a variant thereof, more preferably from a mammalian ribosomal protein Large 32 gene (RPL32), a ribosomal protein Large 35 gene (RPL35), a ribosomal protein Large 21 gene (RPL21), a mammalian ATP synthase, H+ transporting, mitochondrial F1 complex, alpha subunit 1, cardiac muscle (ATP5A1) gene, a mammalian hydroxysteroid (17-beta) dehydrogenase 4 gene (HSD17B4), a mammalian androgen-induced 1 gene (AIG1), a mammalian cytochrome c oxidase subunit VIc gene (COX6C), or a mammalian N-acylsphingosine amidohydrolase (acid ceramidase) 1 gene (ASAH1) or from a variant thereof, most preferably from a human ribosomal protein Large 32 gene (RPL32), a human ribosomal protein Large 35 gene (RPL35), a human ribosomal protein Large 21 gene (RPL21), a human ATP synthase, H+ transporting, mitochondrial F1 complex, alpha subunit 1, cardiac muscle (ATP5A1) gene, a human hydroxysteroid (17-beta) dehydrogenase 4 gene (HSD17B4), a human androgen-induced 1 gene (AIG1), a human cytochrome c oxidase subunit VIc gene (COX6C), or a human N-acylsphingosine amidohydrolase (acid ceramidase) 1 gene (ASAH1) or from a variant thereof, wherein preferably the 5′UTR element does not comprise the 5′TOP of said gene.

Accordingly, in a particularly preferred embodiment, the 5′UTR element comprises or consists of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID No. 1368, or SEQ ID NOs 1452-1460 or a corresponding RNA sequence, or wherein the at least one 5′UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID No. 1368, or SEQ ID NOs 1452-1460 wherein, preferably, the fragment is as described above, i.e. being a continuous stretch of nucleotides representing at least 20% etc. of the full-length 5′UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

Preferably, the at least one 5′UTR element exhibits a length of at least about 20 nucleotides or more, preferably of at least about 30 nucleotides or more, more preferably of at least about 40 nucleotides or more. However, it may be preferred if the 5′UTR element of the artificial nucleic acid molecule is rather short. Accordingly, it may have a length of less than about 200, preferably less than 150, more preferably less than 100 nucleotides. For example, the 5′UTR may have a length of less than about 25, 30, 35, 40, 45, 50, 55, 60, 65, 70, 80, 85, 90, 95, 100, 105, 110, 115, 120, 125, 130, 135, 140, 145, 150, 155, 160, 165, 170, 175, 180, 185, 190, 195, 200 nucleotides Preferably, the 5′UTR element may have a length of about 20-25, 26-30, 31-35, 36-40, 41-45, 46-50, 51-55, 56-60, 61-65, 66-70, 71-80, 81-85, 86-90, 91-95, 96-100, 101-105, 106-110, 111-115, 116-120, 121-125, 126-130, 131-135, 136-140, 141-145, 146-150, 151-155, 156-160, 161-165, 166-170, 171-175, 176-180, 181-185, 186-190, 191-195, 196-200 or more nucleotides. For example, the 5′UTR element may have a length of about 20, 26, 31, 36, 41, 46, 51, 56, 61, 66, 71, 81, 86, 91, 96, 101, 106, 111, 116, 121, 126, 131, 136, 141, 146, 151, 156, 161, 166, 171, 176, 181, 186, 191 or 196 nucleotides. Preferably, the 5′UTR element may have a length from about 20, 30, 40 or more to less than about 200 nucleotides, more preferably from about 20, 30, 40 or more to less than about 150 nucleotides, most preferably from about 20, 30, 40 or more to less than about 100 nucleotides.

Preferred 5′UTR elements are derived from a 5′ UTR of a TOP gene selected from RPSA, RPS2, RPS3, RPS3A, RPS4, RPS5, RPS6, RPS7, RPS8, RPS9, RPS10, RPS11, RPS12, RPS13, RPS14, RPS15, RPS15A, RPS16, RPS17, RPS18, RPS19, RPS20, RPS21, RPS23, RPS24, RPS25, RPS26, RPS27, RPS27A, RPS28, RPS29, RPS30, RPL3, RPL4, RPL5, RPL6, RPL7, RPL7A, RPL8, RPL9, RPL10, RPL10A, RPL11, RPL12, RPL13, RPL13A, RPL14, RPL15, RPL17, RPL18, RPL18A, RPL19, RPL21, RPL22, RPL23, RPL23A, RPL24, RPL26, RPL27, RPL27A, RPL28, RPL29, RPL30, RPL31, RPL32, RPL34, RPL35, RPL35A, RPL36, RPL36A, RPL37, RPL37A, RPL38, RPL39, RPL40, RPL41, RPLP0, RPLP1, RPLP2, RPLP3, RPLP0, RPLP1, RPLP2, EEF1A1, EEF1B2, EEF1D, EEF1G, EEF2, EIF3E, EIF3F, EIF3H, EIF2S3, EIF3C, EIF3K, EIF3EIP, EIF4A2, PABPC1, HNRNPA1, TPT1, TUBB1, UBA52, NPM1, ATP5G2, GNB2L1, NME2, UQCRB or from a variant thereof.

In some embodiments, the artificial nucleic acid molecule comprises a 5′UTR element which comprises or consists of a nucleic acid sequence which is derived from the 5′UTR of a vertebrate TOP gene, such as a mammalian, e.g. a human TOP gene, selected from RPSA, RPS2, RPS3, RPS3A, RPS4, RPS5, RPS6, RPS7, RPS8, RPS9, RPS10, RPS11, RPS12, RPS13, RPS14, RPS15, RPS15A, RPS16, RPS17, RPS18, RPS19, RPS20, RPS21, RPS23, RPS24, RPS25, RPS26, RPS27, RPS27A, RPS28, RPS29, RPS30, RPL3, RPL4, RPL5, RPL6, RPL7, RPL7A, RPL8, RPL9, RPL10, RPL10A, RPL11, RPL12, RPL13, RPL13A, RPL14, RPL15, RPL17, RPL18, RPL18A, RPL19, RPL21, RPL22, RPL23, RPL23A, RPL24, RPL26, RPL27, RPL27A, RPL28, RPL29, RPL30, RPL31, RPL32, RPL34, RPL35, RPL35A, RPL36, RPL36A, RPL37, RPL37A, RPL38, RPL39, RPL40, RPL41, RPLP0, RPLP1, RPLP2, RPLP3, RPLP0, RPLP1, RPLP2, EEF1A1, EEF1B2, EEF1D, EEF1G, EEF2, EIF3E, EIF3F, EIF3H, EIF2S3, EIF3C, EIF3K, EIF3EIP, EIF4A2, PABPC1, HNRNPA1, TPT1, TUBB1, UBA52, NPM1, ATP5G2, GNB2L1, NME2, UQCRB or from a variant thereof, wherein preferably the 5'UTR element does not comprise a TOP motif or the 5'TOP of said genes, and wherein optionally the 5'UTR element starts at its 5'-end with a nucleotide located at position 1, 2, 3, 4, 5, 6, 7, 8, 9 or 10 downstream of the 5'terminal oligopyrimidine tract (TOP) and wherein further optionally the 5'UTR element which is derived from a 5'UTR of a TOP gene terminates at its 3'-end with a nucleotide located at position 1, 2, 3, 4, 5, 6, 7, 8, 9 or 10 upstream of the start codon (A(U/T)G) of the gene it is derived from.

In a particularly preferred embodiment, the artificial nucleic acid molecule further comprises a histone stem-loop.

Accordingly, it is particularly preferred that the artificial nucleic acid molecule according to the present invention comprises:

a. at least one 5'-untranslated region element (5'UTR element) which comprises or consists of a nucleic acid sequence which is derived from the 5'UTR of a TOP gene or which is derived from a variant of the 5'UTR of a TOP gene as described above;
b. at least one open reading frame (ORF); and
c. at least one histone stem-loop.

The combination of a 5'UTR element as described above with a histone stem-loop may have a particularly advantageous effect in providing prolonged and possibly also enhanced translation of an RNA molecule.

In the context of the present invention, such a histone stem-loop is typically derived from a histone gene and comprises an intramolecular base pairing of two neighbored entirely or partially reverse complementary sequences, thereby forming a stem-loop. A stem-loop can occur in single-stranded DNA or, more commonly, in RNA. The structure is also known as a hairpin or hairpin loop and usually consists of a stem and a (terminal) loop within a consecutive sequence, wherein the stem is formed by two neighbored entirely or partially reverse complementary sequences separated by a short sequence as sort of spacer, which builds the loop of the stem-loop structure. The two neighbored entirely or partially reverse complementary sequences may be defined as e.g. stem-loop elements stem1 and stem2.

The stem loop is formed when these two neighbored entirely or partially reverse complementary sequences, e.g. stem-loop elements stem1 and stem2, form base-pairs with each other, leading to a double stranded nucleic acid sequence comprising an unpaired loop at its terminal ending formed by the short sequence located between stem-loop elements stem1 and stem2 on the consecutive sequence. The unpaired loop thereby typically represents a region of the nucleic acid which is not capable of base pairing with either of these stem-loop elements. The resulting lollipop-shaped structure is a key building block of many RNA secondary structures. The formation of a stem-loop structure is thus dependent on the stability of the resulting stem and loop regions, wherein the first prerequisite is typically the presence of a sequence that can fold back on itself to form a paired double strand. The stability of paired stem-loop elements is determined by the length, the number of mismatches or bulges it contains (a small number of mismatches is typically tolerable, especially in a long double strand), and the base composition of the paired region. In the context of the present invention, optimal loop length is 3-10 bases, more preferably 3 to 8, 3 to 7, 3 to 6 or even more preferably 4 to 5 bases, and most preferably 4 bases.

Preferably, the at least one histone stem-loop is functionally associated to the ORF. This means that the at least one histone stem-loop is preferably positioned within the artificial nucleic acid molecule such that it is able to exert its function, for example, its function of increasing protein production from the ORF or stabilizing the artificial nucleic acid molecule.

Preferably, the histone stem-loop is located 3' to the ORF. For example, the histone stem-loop may be connected to the 3'-end of the ORF directly or via a linker, for example via a stretch of nucleotides, such as 2, 4, 6, 8, 10 etc. nucleotides, e.g. comprising one or more restriction sites, or the histone stem-loop may be located within or between or downstream of other structures located 3' to the ORF, such as within a 3'UTR element, or between a poly(A) sequence and a poly(C) sequence, or down-stream of a poly(A) and/or a poly(C) sequence, or the histone stem-loop may be located at the 3'-end of the artificial nucleic acid molecule. The term "located at the 3'-end" also includes embodiments, wherein the histone stem-loop is followed in 3'-direction by few nucleotides which remain, e.g., after a restriction enzyme cleavage.

Preferably, the 5'UTR element and the histone stem-loop are chosen and positioned such that they exert at least an additive, preferably a synergistic function on protein production from the ORF of the artificial nucleic acid molecule. Preferably, protein production from the ORF is increased at least in an additive, preferably in a synergistic way by the 5'UTR element and the histone stem-loop. Thus, the protein amount of the protein encoded by the ORF, such as a reporter protein, e.g. luciferase, at a certain time point after initiation of expression of the ORF, e.g. after transfection of a test cell line, is at least the same, preferably higher than what would be expected if the protein production increasing effects of the 5'UTR element and the histone stem-loop were purely additive. The additive, preferably synergistic effect may, for example, be determined by the following assay. Four artificial nucleic acid molecules, e.g. mRNAs, comprising an ORF encoding, e.g. a reporter protein such as luciferase, are generated, i.e. (i) lacking a 5'UTR element and a histone stem-loop (E0), (ii) containing a 5'UTR element derived from a 5'UTR of a TOP gene or of a variant thereof (E1), (iii) containing a histone stem-loop (E2), and (iv) containing both the 5'UTR element and the histone stem-loop (E1E2). Expression of the ORF contained in the artificial nucleic acid molecules is initiated, for example, by transfecting a test cell line, such as a mammalian cell line, e.g. HELA cells, or primary cells, e.g. HDF cells. Samples are taken at specific time points after initiation of expression, for example, after 6 hours, 24 hours, 48 hours, and/or 72 hours and the amount of protein produced by expression of the ORF contained in the artificial nucleic acid molecules is measured, for example, by an ELISA assay or a luciferase test, depending on the type of protein encoded by the ORF. The predicted amount of protein at a certain time point after initiation of expression obtained by construct E1E2 if the effects of the 3'UTR element and the 5'UTR element were purely additive (PPA) may be calculated as follows:

$$PPA_x = (E1_x - E0_x) + (E2_x - E0_x) + E0_x,$$

E0 is the amount of protein obtained for the construct E0 (lacking a 5'UTR and a histone stem-loop), E1 is the amount of protein obtained for the construct E1, E2 is the protein amount obtained for the construct E2, and x is the time point after initiation of expression. The effect on increasing protein production is additive if $E1E2_x=PPA_x$, and synergistic in the sense of the present invention if $E1E2_x>PPA_x$, wherein $E1E2_x$ is the amount of protein obtained from construct E1E2 at time point x. Preferably, E1E2 is at least 1.0, more preferably at least 1.1, more preferably at least 1.3, more preferably at least 1.5, even more preferably at least 1.75 times PPA at a given time point post initiation of expression, such as 24 hours, 48 hours or 72 hours post initiation of expression.

Thus, in a preferred embodiment, the present invention provides an artificial nucleic acid molecule comprising (a.) at least one 5'UTR element which comprises or consists of a nucleic acid sequence which is derived from the 5'UTR of a TOP gene or which is derived from a variant of the 5'UTR of a TOP gene as described above; (b.) at least one open reading frame (ORF); and (c.) at least one histone stem-loop as described herein, wherein the histone stem-loop and the 5'UTR element act at least additively, preferably synergistically to increase protein production from the ORF, preferably wherein E1E2≥PPA, preferably E1E2 is at least PPA, more preferably E1E2 is at least 1.1 times PPA, more preferably E1E2 is at least 1.3 times PPA, even more preferably wherein E1E2 is at least 1.5 times PPA at a given time point post initiation of expression of the ORF, for example 24 hours, preferably 48 hours post initiation of expression, wherein E1E2 and PPA are as described above.

Furthermore, it is preferred that the at least one histone stem-loop and the at least one 5'UTR element have an at least additive, preferably a synergistic effect on total protein production from the artificial nucleic acid molecule in a certain time span, such as within 24 hours, 48 hours, or 72 hours post initiation of expression. The additive, preferably the synergistic effect may be determined as described above, with the difference that the area under the curve (AUC) for the amount of protein over time predicted for E1E2 if the effects are additive is compared to the actual AUC measured for E1E2.

In a preferred embodiment of the present invention, the inventive artificial nucleic acid molecule comprises or codes for (a.) at least one 5'UTR element as described above, (b.) at least one open reading frame; and (c.) at least one histone stem-loop, preferably according to at least one of the following formulae (I) or (II):

formula (I) (stem-loop sequence without stem bordering elements):

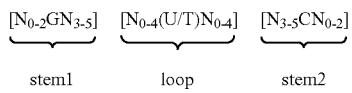

formula (II) (stem-loop sequence with stem bordering elements):

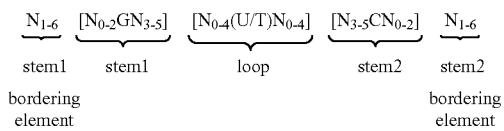

wherein:

stem1 or stem2 bordering element $N_{1-6}$ is a consecutive sequence of 1 to 6, preferably of 2 to 6, more preferably of 2 to 5, even more preferably of 3 to 5, most preferably of 4 to 5 or 5 N, wherein each N is independently from another selected from a nucleotide selected from A, U, T, G and C, or a nucleotide analogue thereof;

stem1 $[N_{0-2}GN_{3-5}]$ is reverse complementary or partially reverse complementary with element stem2, and is a consecutive sequence of between 5 to 7 nucleotides;

wherein $N_{0-2}$ is a consecutive sequence of 0 to 2, preferably of 0 to 1, more preferably of 1 N, wherein each N is independently from another selected from a nucleotide selected from A, U, T, G and C or a nucleotide analogue thereof;

wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof, and wherein G is guanosine or an analogue thereof, and may be optionally replaced by a cytidine or an analogue thereof, provided that its complementary nucleotide cytidine in stem2 is replaced by guanosine;

loop sequence $[N_{0-4}(U/T)N_{0-4}]$ is located between elements stem1 and stem2, and is a consecutive sequence of 3 to 5 nucleotides, more preferably of 4 nucleotides;

wherein each $N_{0-4}$ is independent from another a consecutive sequence of 0 to 4, preferably of 1 to 3, more preferably of 1 to 2 N, wherein each N is independently from another selected from a nucleotide selected from A, U, T, G and C or a nucleotide analogue thereof; and wherein U/T represents uridine, or optionally thymidine;

stem2 $[N_{3-5}CN_{0-2}]$ is reverse complementary or partially reverse complementary with element stem1, and is a consecutive sequence of between 5 to 7 nucleotides;

wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof;

wherein $N_{0-2}$ is a consecutive sequence of 0 to 2, preferably of 0 to 1, more preferably of 1 N, wherein each N is independently from another selected from a nucleotide selected from A, U, T, G or C or a nucleotide analogue thereof; and wherein C is cytidine or an analogue thereof, and may be optionally replaced by a guanosine or an analogue thereof provided that its complementary nucleotide guanosine in stem1 is replaced by cytidine;

wherein stem1 and stem2 are capable of base pairing with each other forming a reverse complementary sequence, wherein base pairing may occur between stem1 and stem2, e.g. by Watson-Crick base pairing of nucleotides A and U/T or G and C or by non-Watson-Crick base pairing e.g. wobble base pairing, reverse Watson-Crick base pairing, Hoogsteen base pairing, reverse Hoogsteen base pairing or are capable of base pairing with each other forming a partially reverse complementary sequence, wherein an incomplete base pairing may occur between stem1 and stem2, on the basis that one ore more bases in one stem do not have a complementary base in the reverse complementary sequence of the other stem.

In the above context, a wobble base pairing is typically a non-Watson-Crick base pairing between two nucleotides. The four main wobble base pairs in the present context, which may be used, are guanosine-uridine, inosine-uridine, inosine-adenosine, inosine-cytidine (G-U/T, I-U/T, I-A and I-C) and adenosine-cytidine (A-C).

Accordingly, in the context of the present invention, a wobble base is a base, which forms a wobble base pair with a further base as described above. Therefore, non-Watson-Crick base pairing, e.g. wobble base pairing, may occur in the stem of the histone stem-loop structure according to the present invention.

In the above context, a partially reverse complementary sequence comprises maximally two, preferably only one mismatch in the stem-structure of the stem-loop sequence formed by base pairing of stem1 and stem2. In other words, stem1 and stem2 are preferably capable of (full) base pairing with each other throughout the entire sequence of stem1 and stem2 (100% of possible correct Watson-Crick or non-Watson-Crick base pairings), thereby forming a reverse complementary sequence, wherein each base has its correct Watson-Crick or non-Watson-Crick base pendant as a complementary binding partner. Alternatively, stem1 and stem2 are preferably capable of partial base pairing with each other throughout the entire sequence of stem1 and stem2, wherein at least about 70%, 75%, 80%, 85%, 90%, or 95% of the 100% possible correct Watson-Crick or non-Watson-Crick base pairings are occupied with the correct Watson-Crick or non-Watson-Crick base pairings and at most about 30%, 25%, 20%, 15%, 10%, or 5% of the remaining bases are unpaired.

According to a preferred embodiment of the invention, the at least one histone stem-loop sequence (with stem bordering elements) of the inventive nucleic acid sequence as defined herein comprises a length of about 15 to about 45 nucleotides, preferably a length of about 15 to about 40 nucleotides, preferably a length of about 15 to about 35 nucleotides, preferably a length of about 15 to about 30 nucleotides and even more preferably a length of about 20 to about 30 and most preferably a length of about 24 to about 28 nucleotides.

Furthermore, the at least one histone stem-loop sequence (without stem bordering elements) of the inventive artificial nucleic acid molecule as defined herein may comprise a length of about 10 to about 30 nucleotides, preferably a length of about 10 to about 20 nucleotides, preferably a length of about 12 to about 20 nucleotides, preferably a length of about 14 to about 20 nucleotides and even more preferably a length of about 16 to about 17 and most preferably a length of about 16 nucleotides.

Preferably, the inventive artificial nucleic acid molecule may comprise or code for (a.) at least one 5'UTR element as described above; at least one open reading frame; and (c.) at least one histone stem-loop sequence according to at least one of the following specific formulae (Ia) or (IIa):
formula (Ia) (stem-loop sequence without stem bordering elements):

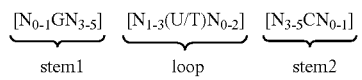

formula (IIa) (stem-loop sequence with stem bordering elements):

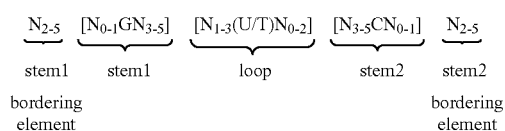

wherein N, C, G, T and U are as defined above.

Preferably, the inventive artificial nucleic acid molecule may comprise or code for (a.) at least one 5'UTR element as described above; at least one open reading frame; and (c.) at least one histone stem-loop sequence according to at least one of the following specific formulae (Ib) or (IIb):
formula (Ib) (stem-loop sequence without stem bordering elements):

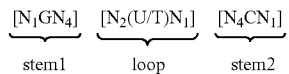

formula (IIb) (stem-loop sequence with stem bordering elements):

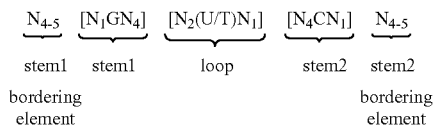

wherein N, C, G, T and U are as defined above.

Preferably, the inventive artificial nucleic acid molecule may comprise or code for (a.) at least one 5'UTR element as described above; at least one open reading frame; and (c.) at least one histone stem-loop sequence according to at least one of the following specific formulae (Ic) to (Ih) or (IIc) to (IIh), shown alternatively in its stem-loop structure and as a linear sequence representing histone stem-loop sequences as generated according to Example 1:
formula (Ic): (metazoan and protozoan histone stem-loop consensus sequence without stem bordering elements):

```
        N U
       N   N
       N-N
       N-N
       N-N
       N-N
       G-C
       N-N  (stem-loop structure)
                            (SEQ ID NO: 1391)
  NGNNNNNNNUNNNNNCN
    (linear sequence)
``` formula (IIc): (metazoan and protozoan histone stem-loop consensus sequence with stem bordering elements):

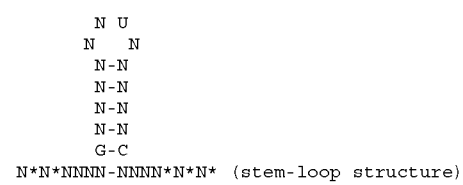

formula (Id): (without stem bordering elements)

-continued
```
        N-N
        N-N
        N-N
        C-G
        N-N (stem-loop structure)
```
(SEQ ID NO: 1393)
NCNNNNNNUNNNNNGN
(linear sequence)

formula (IId): (with stem bordering elements)

```
        N U
        N   N
        N-N
        N-N
        N-N
        N-N
        C-G
N*N*NNNN-NNNN*N*N* (stem-loop structure)
```
(SEQ ID NO: 1394)
N*N*NNNNCNNNNNNUNNNNNGNNNN*N*N*
(linear sequence)

formula (Ie): (protozoan histone stem-loop consensus sequence without stem bordering elements)

```
        N U
        N   N
        N-N
        N-N
        N-N
        N-N
        G-C
        D-H (stem-loop structure)
```
(SEQ ID NO: 1395)
DGNNNNNNUNNNNNCH
(linear sequence)

formula (IIe): (protozoan histone stem-loop consensus sequence with stem bordering elements)

```
        N U
        N   N
        N-N
        N-N
        N-N
        N-N
        G-C
N*N*NNND-HNNN*N*N* (stem-loop structure)
```
(SEQ ID NO: 1396)
N*N*NNNDGNNNNNNUNNNNNCHNNN*N*N*
(linear sequence)

formula (If): (metazoan histone stem-loop consensus sequence without stem bordering elements)

```
        N U
        N   N
        Y-V
        Y-N
        B-D
        N-N
        G-C
        N-N (stem-loop structure)
```
(SEQ ID NO: 1397)
NGNBYYNNUNVNDNCN
(linear sequence)

formula (IIf): (metazoan histone stem-loop consensus sequence with stem bordering elements)

```
        N U
        N   N
        Y-V
        Y-N
        B-D
        N-N
        G-C
N*N*NNNN-NNNN*N*N* (stem-loop structure)
```
(SEQ ID NO: 1398)
N*N*NNNNGNBYYNNUNVNDNCNNNN*N*N*
(linear sequence)

formula (Ig): (vertebrate histone stem-loop consensus sequence without stem bordering elements)

```
        N U
        D   H
        Y-A
        Y-B
        Y-R
        H-D
        G-C
        N-N (stem-loop structure)
```
(SEQ ID NO: 1399)
NGHYYYDNUHABRDCN
(linear sequence)

formula (IIg): (vertebrate histone stem-loop consensus sequence with stem bordering elements)

```
        N U
        D   H
        Y-A
        Y-B
        Y-R
        H-D
        G-C
N*N*HNNN-NNNN*N*H* (stem-loop structure)
```
(SEQ ID NO: 1400)
N*N*HNNNGHYYYDNUHABRDCNNNN*N*H*
(linear sequence)

formula (Ih): (human histone stem-loop consensus sequence (*Homo sapiens*) without stem bordering elements)

```
        Y U
        D   H
        U-A
        C-S
        Y-R
        H-R
        G-C
        D-C (stem-loop structure)
```
(SEQ ID NO: 1401)
DGHYCUDYUHASRRCC
(linear sequence)

formula (IIh): (human histone stem-loop consensus sequence (*Homo sapiens*) with stem bordering elements)

```
        Y U
        D   H
        U-A
        C-S
        Y-R
        H-R
        G-C
N*H*AAHD-CVHB*N*H* (stem loop structure)
```

(SEQ ID NO: 1402)
N*H*AAHDGHYCUDYUHASRRCCVHB*N*H*
(linear sequence)

wherein in each of above formulae (Ic) to (Ih) or (Ic) to (Ih):
N, C, G, A, T and U are as defined above;
each U may be replaced by T;
each (highly) conserved G or C in the stem elements 1 and 2 may be replaced by its complementary nucleotide base C or G, provided that its complementary nucleotide in the corresponding stem is replaced by its complementary nucleotide in parallel; and/or
G, A, T, U, C, R, Y, M, K, S, W, H, B, V, D, and N are nucleotide bases as defined in the following Table:

| abbreviation | Nucleotide bases | remark |
|---|---|---|
| G | G | Guanine |
| A | A | Adenine |
| T | T | Thymine |
| U | U | Uracile |
| C | C | Cytosine |
| R | G or A | Purine |
| Y | T/U or C | Pyrimidine |
| M | A or C | Amino |
| K | G or T/U | Keto |
| S | G or C | Strong (3H bonds) |
| W | A or T/U | Weak (2H bonds) |
| H | A or C or T/U | Not G |
| B | G or T/U or C | Not A |
| V | G or C or A | Not T/U |
| D | G or A or T/U | Not C |
| N | G or C or T/U or A | Any base |
| * | Present or not | Base may be present or not |

In this context, it is particularly preferred that the histone stem-loop sequence according to at least one of the formulae (I) or (Ia) to (Ih) or (II) or (IIa) to (IIh) of the present invention is selected from a naturally occurring histone stem-loop sequence, more particularly preferred from protozoan or metazoan histone stem-loop sequences, and even more particularly preferred from vertebrate and mostly preferred from mammalian histone stem-loop sequences especially from human histone stem-loop sequences.

Further preferably, the histone stem-loop sequence according to at least one of the specific formulae (I) or (Ia) to (Ih) or (II) or (IIa) to (IIh) of the present invention is a histone stem-loop sequence comprising at each nucleotide position the most frequently occurring nucleotide, or either the most frequently or the second-most frequently occurring nucleotide of naturally occurring histone stem-loop sequences in metazoa and protozoa (FIG. 1), protozoa (FIG. 2), metazoa (FIG. 3), vertebrates (FIG. 4) and humans (FIG. 5) as shown in FIGS. 1-5. In this context, it is particularly preferred that at least 80%, preferably at least 85%, or most preferably at least 90% of all nucleotides correspond to the most frequently occurring nucleotide of naturally occurring histone stem-loop sequences.

Further preferably, the histone stem-loop sequence according to at least one of the specific formulae (I) or (Ia) to (Ih) of the present invention may be selected from following histone stem-loop sequences or corresponding RNA sequences (without stem-bordering elements) representing histone stem-loop sequences as generated according to Example 1:

(SEQ ID NO: 1403 according to formula (Ic))
VGYYYYHHTHRVVRCB (SEQ ID NO: 1404 according to formula (Ic))
SGYYYTTYTMARRRCS (SEQ ID NO: 1405 according to formula (Ic))
SGYYCTTTTMAGRRCS (SEQ ID NO: 1406 according to formula (Ie))
DGNNNBNNTHVNNNCH (SEQ ID NO: 1407 according to formula (Ie))
RGNNNYHBTHRDNNCY (SEQ ID NO: 1408 according to formula (Ie))
RGNDBYHYTHRDHNCY (SEQ ID NO: 1409 according to formula (If))
VGYYYTYHTHRVRRCB (SEQ ID NO: 1410 according to formula (If))
SGYYCTTYTMAGRRCS (SEQ ID NO: 1411 according to formula (If))
SGYYCTTTTMAGRRCS (SEQ ID NO: 1412 according to formula (Ig))
GGYYCTTYTHAGRRCC (SEQ ID NO: 1413 according to formula (Ig))
GGCYCTTYTMAGRGCC (SEQ ID NO: 1414 according to formula (Ig))
GGCTCTTTTMAGRGCC (SEQ ID NO: 1415 according to formula (Ih))
DGHYCTDYTHASRRCC (SEQ ID NO: 1416 according to formula (Ih))
GGCYCTTTTHAGRGCC (SEQ ID NO: 1417 according to formula (Ih))
GGCYCTTTTMAGRGCC Furthermore, in this context, following histone stem-loop sequences (with stem bordering elements) as generated according to Example 1 according to one of specific formulae (II) or (IIa) to (IIh) and the corresponding RNA sequences are particularly preferred:

(SEQ ID NO: 1418 according to formula (IIc))
H*H*HHVVGYYYYHHTHRVVRCBVHH*N*N*

(SEQ ID NO: 1419 according to formula (IIc))
M*H*MHMSGYYYTTYTMARRRCSMCH*H*H*

(SEQ ID NO: 1420 according to formula (IIc))
M*M*MMMSGYYCTTTTMAGRRCSACH*M*H*

(SEQ ID NO: 1421 according to formula (IIe))
N*N*NNNDGNNNBNNTHVNNNCHNHN*N*N*

(SEQ ID NO: 1422 according to formula (IIe))
N*N*HHNRGNNNYHBTHRDNNCYDHH*N*N*

(SEQ ID NO: 1423 according to formula (IIe))
N*H*HHVRGNDBYHYTHRDHNCYRHH*H*H*

(SEQ ID NO: 1424 according to formula (IIf))
H*H*MHMVGYYYTYHTHRVRRCBVMH*H*N*

(SEQ ID NO: 1425 according to formula (IIf))
M*M*MMMSGYYCTTYTMAGRRCSMCH*H*H*

(SEQ ID NO: 1426 according to formula (IIf))
M*M*MMMSGYYCTTTTMAGRRCSACH*H*H*

(SEQ ID NO: 1427 according to formula (IIg))
H*h*MAMGGYYCTTYTHAGRRCCVHN*N*M*

(SEQ ID NO: 1428 according to formula (IIg))
H*H*AAMGGCYCTTYTMAGRGCCVCH*H*M*

-continued (SEQ ID NO: 1429 according to formula (IIg))
M*M*AAMGGCTCTTTTMAGRGCCMCY*M*M*

(SEQ ID NO: 1430 according to formula (IIh))
N*H*AAHDGHYCTDYTHASRRCCVHB*N*H*

(SEQ ID NO: 1431 according to formula (IIh))
H*H*AAMGGCYCTTTTHAGRGCCVMY*N*M*

(SEQ ID NO: 1432 according to formula (IIh))
H*M*AAAGGCYCTTTTMAGRGCCRMY*H*M*

A particular preferred histone stem-loop sequence is the sequence according to SEQ ID NO: 1433 (CAAAGGCTCTTTTCAGAGCCACCA) or the corresponding RNA sequence.

Thus, in a particularly preferred embodiment, the artificial nucleic acid molecule according to the present invention comprises (a.) at least one 5'UTR element as described above; (b.) at least one open reading frame; and (c.) at least one histone-stem loop which comprises or consists of a sequence having a sequence identity of at least about 75%, preferably of at least about 80%, preferably at least about 85%, more preferably at least about 90%, even more preferably at least about 95% to the sequence according to SEQ ID NO. 1433 or the corresponding RNA sequence, wherein preferably positions 6, 13 and 20 of the sequence having a sequence identity of at least about 75%, preferably of at least about 80%, preferably at least about 85%, more preferably at least about 90%, even more preferably at least about 95% to the sequence according to SEQ ID NO. 1433 or the corresponding RNA sequence are conserved, i.e. are identical to the nucleotides at positions 6, 13 and 20 of SEQ ID NO. 1433.

According to a further preferred embodiment, the inventive artificial nucleic acid molecule comprises or codes for at least one histone stem-loop sequence showing at least about 80%, preferably at least about 85%, more preferably at least about 90%, or even more preferably at least about 95% sequence identity with the not to 100% conserved nucleotides in the histone stem-loop sequences according to at least one of specific formulae (I) or (Ia) to (Ih) or (II) or (IIa) to (IIh) or with a naturally occurring histone stem-loop sequence.

Furthermore, the artificial nucleic acid molecule according to the present invention may comprise more than one histone stem-loop as described herein. For example, the artificial nucleic acid molecule according to the present invention may comprise one, two, three, four or more histone stem-loops, wherein the individual histone stem-loops may be the same or they may be different. For example, the artificial nucleic acid molecule according to the present invention may comprise two histone stem-loops, wherein each histone stem-loop sequence may be selected from the group consisting of SEQ ID NOs. 1391-1433.

In a particularly preferred embodiment, the present invention provides an artificial nucleic acid molecule comprising:
a. at least one 5'-untranslated region element (5'UTR element) which comprises or consists of a nucleic acid sequence which is derived from the 5'UTR of a TOP gene or which is derived from a variant of the 5'UTR of a TOP gene as described above;
b. at least one open reading frame (ORE); and
c. at least one histone stem-loop, wherein preferably the sequence of the histone stem-loop is selected from the group consisting of sequences according to formulae (I) or (Ia) to (Ih) or (II) or (IIa) to (IIh), such as a sequence selected from the group consisting of SEQ ID NOs: 1391-1433, preferably from the group consisting of SEQ ID NOs. 1403-1433.

Thus, for example, the artificial nucleic acid molecule according to the present invention may comprise at least one 5'UTR element which is derived from the 5'UTR of a sequence selected from the group consisting of SEQ ID NOs. 1-1363, SEQ ID NO. 1435, SEQ ID NO. 1461 or SEQ ID NO. 1462, from a homolog thereof, from a variant thereof, or from a corresponding RNA sequence, such as a 5'UTR element which comprises or consists of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to a nucleic acid sequence extending from nucleotide position 5 to the nucleotide position immediately 5' to the start codon (located at the 3' end of the sequences), e.g. the nucleotide position immediately 5' to the ATG sequence, of a nucleic acid sequence selected from SEQ ID NOs. 1-1363, SEQ ID NO. 1435, SEQ ID NO. 1461 or SEQ ID NO. 1462, or a corresponding RNA sequence, or at least one 5'UTR element which comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to a nucleic acid sequence extending from nucleotide position 5 to the nucleotide position immediately 5' to the start codon (located at the 3' end of the sequences), e.g. the nucleotide position immediately 5' to the ATG sequence, of a nucleic acid sequence selected from SEQ ID NOs. 1-1363, SEQ ID NO. 1435, SEQ ID NO. 1461 or SEQ ID NO. 1462, or a corresponding RNA sequence, preferably lacking the 5/TOP motif, wherein, preferably, the fragment is as described above, i.e. being a continuous stretch of nucleotides representing at least 20% etc. of the full-length 5'UTR the fragment is derived from, (b.) at least one open reading frame, and (c.) at least one histone stem-loop sequence selected from the group consisting of SEQ ID NOs: 1391-1433, preferably from the group consisting of SEQ ID NOs: 1403-1433, preferably wherein the at least one histone-stem loop comprises or consists of a sequence having a sequence identity of at least about 75%, preferably of at least about 80%, preferably at least about 85%, more preferably at least about 90%, even more preferably at least about 95% to the sequence according to SEQ ID NO. 1433 or the corresponding RNA sequence, wherein preferably positions 6, 13 and 20 of the sequence having a sequence identity of at least about 75%, preferably of at least about 80%, preferably at least about 85%, more preferably at least about 90%, even more preferably at least about 95% to the sequence according to SEQ ID NO. 1433 or the corresponding RNA sequence are conserved, i.e. are identical to the nucleotides at positions 6, 13 and 20 of SEQ ID NO. 1433.

Furthermore, for example, the artificial nucleic acid molecule according to the present invention may comprise at least one 5'UTR element which comprises or consists of a nucleic acid sequence which is derived from a 5'UTR of a TOP gene encoding a ribosomal protein or from a variant of a 5'UTR of a TOP gene encoding a ribosomal protein, e.g. which comprises or consists of a nucleic acid sequence which is derived from a 5'UTR of a nucleic acid sequence according to any of SEQ ID NOs: 170, 232, 244, 259, 1284, 1285, 1286, 1287, 1288, 1289, 1290, 1291, 1292, 1293, 1294, 1295, 1296, 1297, 1298, 1299, 1300, 1301, 1302, 1303, 1304, 1305, 1306, 1307, 1308, 1309, 1310, 1311, 1312, 1313, 1314, 1315, 1316, 1317, 1318, 1319, 1320, 1321, 1322, 1323, 1324, 1325, 1326, 1327, 1328, 1329, 1330, 1331, 1332, 1333, 1334, 1335, 1336, 1337, 1338, 1339, 1340, 1341, 1342, 1343, 1344, 1346, 1347, 1348, 1349, 1350, 1351, 1352, 1353, 1354, 1355, 1356, 1357, 1358, 1359, or 1360; a corresponding RNA sequence, a homolog thereof, or a variant thereof as described herein, and at least one histone stem-loop sequence selected from the group consisting of SEQ ID NOs: 1391-1433, preferably from the group consisting of SEQ ID NOs: 1403-1433, preferably wherein the at least one histone-stem loop comprises or consists of a sequence having a sequence identity of at least about 75%, preferably of at least about 80%, preferably at least about 85%, more preferably at least about 90%, even more preferably at least about 95% to the sequence according to SEQ ID NO. 1433 or the corresponding RNA sequence, wherein preferably positions 6, 13 and 20 of the sequence having a sequence identity of at least about 75%, preferably of at least about 80%, preferably at least about 85%, more preferably at least about 90%, even more preferably at least about 95% to the sequence according to SEQ ID NO. 1433 or the corresponding RNA sequence are conserved, i.e. are identical to the nucleotides at positions 6, 13 and 20 of SEQ ID NO. 1433.

In a further embodiment, the artificial nucleic acid molecule according to the present invention may comprise at least one 5'UTR element which comprises or consists of a nucleic acid sequence which is derived from a 5'UTR of a TOP gene encoding a ribosomal Large protein or from a variant of a 5'UTR of a TOP gene encoding a ribosomal Large protein, e.g. which comprises or consists of a nucleic acid sequence which is derived from a 5'UTR of a nucleic acid sequence according to any of SEQ ID NOs: 67, 259, 1284-1318, 1344, 1346, 1348-1354, 1357, 1461 and 1462, a corresponding RNA sequence, a homolog thereof, or a variant thereof as described herein, and at least one histone stem-loop sequence selected from the group consisting of SEQ ID NOs: 1391-1433, preferably from the group consisting of SEQ ID NOs: 1403-1433, preferably wherein the at least one histone histone-stem loop comprises or consists of a sequence having a sequence identity of at least about 75%, preferably of at least about 80%, preferably at least about 85%, more preferably at least about 90%, even more preferably at least about 95% to the sequence according to SEQ ID NO. 1433 or the corresponding RNA sequence, wherein preferably positions 6, 13 and 20 of the sequence having a sequence identity of at least about 75%, preferably of at least about 80%, preferably at least about 85%, more preferably at least about 90%, even more preferably at least about 95% to the sequence according to SEQ ID NO. 1433 or the corresponding RNA sequence are conserved, i.e. are identical to the nucleotides at positions 6, 13 and 20 of SEQ ID NO. 1433.

As preferred example, the artificial nucleic acid molecule according to the present invention may comprise a 5'UTR element which comprises or consists of a nucleic acid sequence which has an identity of at least about 90%, preferably of at least about 95%, even more preferably of at least about 99% to the nucleic acid sequence according to SEQ ID NO: 1368 or SEQ ID NOs: 1452-1460 and a histone stem-loop sequence selected from the group consisting of SEQ ID NOs: 1403-1433, e.g. according to SEQ ID NO: 1433, or wherein the histone histone-stem loop comprises or consists of a sequence having a sequence identity of about 90%, even more preferably at least about 95% to the sequence according to SEQ ID NO. 1433 or the corresponding RNA sequence, wherein positions 6, 13 and 20 of the sequence having a sequence identity of at least about 90%, even more preferably at least about 95% to the sequence according to SEQ ID NO. 1433 or the corresponding RNA sequence are conserved, i.e. are identical to the nucleotides at positions 6, 13 and 20 of SEQ ID NO. 1433.

In some embodiments, the histone stem-loop sequence according to component (c.) is not derived from a mouse histone gene, e.g. from mouse histone gene H2A614. In one embodiment, the artificial nucleic acid molecule of the invention neither contains a mouse histone stem-loop sequence nor contains mouse histone gene H2A614. Furthermore, in one embodiment, the inventive artificial nucleic acid molecule does not contain a stem-loop processing signal, more specifically, a mouse histone processing signal and, most specifically, does not contain mouse histone stem-loop processing signal H2kA614. Also, in one embodiment, the inventive nucleic acid molecule may contain at least one mammalian histone gene. However, in one embodiment, the at least one mammalian histone gene is not Seq. ID No. 7 of WO 01/12824.

Preferably, the inventive artificial nucleic acid molecule comprises no histone downstream element (HDE).

The term "histone downstream element (HDE)" refers to a purine-rich polynucleotide stretch of about 15 to 20 nucleotides 3' of naturally occurring stem-loops, which represents the binding site for the U7 snRNA involved in processing of histone pre-mRNA into mature histone mRNA. For example in sea urchins the HDE is CAAGAAAGA (Dominski, Z. and W. F. Marzluff (2007), Gene 396(2): 373-90).

Preferably, the artificial nucleic acid molecule according to the present invention further comprises a poly(A) sequence or a poly(A) signal.

Therefore, it is particularly preferred that the inventive artificial nucleic acid molecule comprises or codes for (a.) at least one 5'UTR element as described above, (b.) at least one open reading frame, preferably encoding a peptide or protein; (c.) at least one histone stem-loops described herein, and (d.) a poly(A) sequence or a polyadenylation signal.

A polyadenylation signal is defined herein as a signal which conveys polyadenylation to a (transcribed) mRNA by specific protein factors (e.g. cleavage and polyadenylation specificity factor (CPSF), cleavage stimulation factor (CstF), cleavage factors I and II (CF I and CF II), poly(A) polymerase (PAP)).

Preferably, the polyadenylation signal comprises the consensus sequence NN(U/T)ANA, with N=A or U, preferably AA(U/T)AAA or A(U/T)(U/T)AAA. Such consensus sequence may be recognised by most animal and bacterial cell-systems, for example by the polyadenylation-factors, such as cleavage/polyadenylation specificity factor (CPSF) cooperating with CstF, PAP, PAB2, CFI and/or CFII. The polyadenylation signal is preferably located within the artificial nucleic acid molecule such that the above described machinery is able to effect polyadenylation of the artificial nucleic acid molecule. For example, the polyadenylation signal may be located less than about 50 nucleotides, more preferably less than about 30 nucleotides, most preferably less than about 25 nucleotides, for example 21 nucleotides, upstream of the 3'-end of the artificial nucleic acid molecule.

Additionally or alternatively to the polyadenylation signal, in some embodiments, the artificial nucleic acid molecule according to the present invention may further comprise a poly(A) sequence. The length of the poly(A) sequence may vary. For example, the poly(A) sequence may have a length of about 20 adenine nucleotides up to about 400 adenine nucleotides, such as about 20 adenine nucleotides up to about 300 adenine nucleotides, preferably about 40 to about 200 adenine nucleotides, more preferably about 50 to about 100 adenine nucleotides, such as about 60, 70, 80, 90 or 100 adenine nucleotides. The term about refers to a deviation of ±10%.

The poly(A) sequence is preferably located 3' to the ORF. For example, the poly(A) sequence may be connected to the 3'-end of the ORF directly or via a linker, for example via a stretch of nucleotides, such as 2, 4, 6, 8, 10, 20 etc. nucleotides, such as via a linker of 1-50, preferably 1-20 nucleotides, e.g. comprising one or more restriction sites, or the poly(A) sequence may be located within or between or downstream of other structures located 3' to the ORF, such as between a 3'UTR element and a poly(C) sequence, or downstream of a 3'UTR element and/or a poly(C) sequence, or the poly(A) sequence may be located at the 3'-end of the artificial nucleic acid molecule. The term "located at the 3'-end" also includes embodiments, wherein the poly(A) sequence is followed in 3'-direction by few nucleotides which remain, e.g. after a restriction enzyme cleavage.

It is particularly preferred that the inventive artificial nucleic acid molecule comprises in 5'- to 3'-direction or codes in 5'- to 3'-direction for
(a.) at least one 5'UTR element derived from a TOP gene as described herein;
(b.) at least one open reading frame, preferably encoding a peptide or protein;
(c.) at least one histone stem-loop, optionally without a histone downstream element 3' to the histone stem-loop, as described herein; and
(d.) a poly(A) sequence and/or a polyadenylation signal.

In another particularly preferred embodiment, the inventive nucleic acid molecule according to the present invention comprises in 5'- to 3'-direction or codes in 5'- to 3'-direction for:
(a.) at least one 5'UTR element derived from a TOP gene as described above;
(b.) at least one open reading frame, preferably encoding a peptide or protein;
(d.) a poly(A) sequence; and
(c.) at least one histone stem-loop as described herein.

Thus, the poly(A) sequence and the histone stem-loop of an artificial nucleic acid molecule according to the present invention may be positioned in any desired order from 5' to 3'. Particularly, the poly(A) sequence may be located 5' as well as 3' of the histone stem-loop.

Accordingly, in one embodiment, the artificial nucleic acid molecule according to the present invention comprises
(a.) at least one 5'-untranslated region element (5'UTR element) which comprises or consists of a nucleic acid sequence which is derived from the 5'UTR of a TOP gene or which is derived from a variant of the 5'UTR of a TOP gene;
(b.) at least one open reading frame (ORF);
(c.) a histone stem-loop; and
(d.) a poly(A) sequence and/or a polyadenylation signal, wherein the poly(A) sequence is located 5' or 3' of the histone stem-loop.

In a further preferred embodiment, the artificial nucleic acid molecule according to the present invention further comprises a poly(C) sequence. A poly(C) sequence in the context of the present invention preferably consists of about 10 to about 200 cytidine nucleotides, more preferably of about 10 to about 100 cytidine nucleotides, more preferably of about 10 to about 50 cytidine nucleotides, even more preferably of about 20 to about 40 cytidine nucleotides, such as about 20, about 25, about 30, about 35, about 40, preferably about 30 cytidine nucleotides. The poly(C) sequence is preferably located 3' to the ORF of the artificial nucleic acid molecule. For example, the poly(C) sequence may be connected to the 3'-end of the ORF directly or via a linker of a stretch of nucleotides, such as 2, 4, 6, 8, 10, 20 etc. nucleotides, such as via a linker of 1-50, preferably of 1-20 nucleotides, e.g. comprising one or more restriction sites, or the poly(C) sequence may be located within, between or downstream of any other structures located 3' to the ORF. For example, the poly(C) sequence may be part of a 3'UTR element or may be located between a poly(A) sequence and a histone stem-loop, or the poly(C) sequence may be located at the 3'-end of the artificial nucleic acid molecule. The term "located at the 3'-end" also includes embodiments, wherein the poly(C) sequence is followed in 3'-direction by a few nucleotides which remain, e.g., after a restriction enzyme cleavage. In a particularly preferred embodiment, the poly(C) sequence is located between a poly(A) sequence and a histone stem-loop.

In a particularly preferred embodiment, the poly(C) sequence is located 5' to the histone stem-loop.

Thus, in a particularly preferred embodiment, the artificial nucleic acid molecule according to the present application comprises the structure 5'-[ORF]-[optional linker]-[3'UTR element]-[optional linker]-[poly(A) sequence]-[optional linker]-[poly(C) sequence]-[optional linker]-[histone stem-loop]-3', wherein the optional linkers may be independently of each other present or absent and may be a stretch of 1-50 nucleotides, e.g. comprising one or more restriction sites.

In a further embodiment, the artificial nucleic acid molecule according to the present invention further comprises a 3'UTR element. Thus, in some embodiments, the artificial nucleic acid molecule according to the present invention may comprise at least one 5'UTR element as described above, at least one open reading frame, at least one histone stem-loop as described herein and at least one 3'UTR element as described herein. Furthermore, in some embodiments, the artificial nucleic acid molecule according to the present invention may comprise at least one 5'UTR element as described above, at least one open reading frame, at least one histone stem-loop as described herein, at least one 3'UTR element as described herein, and a poly(A) sequence and/or a polyadenylation signal as described herein. In some embodiments, the histone stem-loop may be part of the 3'UTR element.

The term '3'UTR element' refers to a nucleic acid sequence which comprises or consists of a nucleic acid sequence that is derived from a 3'UTR or from a variant of a 3'UTR. A 3'UTR element in the sense of the present invention may represent the 3'UTR of an mRNA, e.g., in the event that the artificial nucleic acid molecule is an mRNA, or it may represent a sequence in a nucleic acid construct, such as a vector construct, that when transcribed represents the 3'UTR of the transcription product, such as the mRNA. Thus, in the sense of the present invention, preferably, a 3'UTR element may be the 3'UTR of an mRNA, preferably of an artificial mRNA, or it may be the transcription template for a 3'UTR of an mRNA. Thus, a 3'UTR element preferably is a nucleic acid sequence which corresponds to the 3'UTR of an mRNA, preferably to the 3'UTR of an artificial mRNA, such as an mRNA obtained by transcription of a genetically engineered vector construct. Preferably, the 3'UTR element fulfils the function of a 3'UTR or encodes a sequence which fulfils the function of a 3'UTR. The term '3UTR element' furthermore refers to a fragment or part of a 3'UTR of an artificial nucleic acid sequence, such as an artificial mRNA, or which codes for a part or fragment of a 3'UTR of an artificial nucleic acid molecule. This means that the 3'UTR element in the sense of the present invention may be comprised in the 3'UTR of an artificial nucleic acid sequence, such as an artificial mRNA, or which codes for a 3'UTR of an artificial nucleic acid molecule.

In the context of the present invention, the 3'UTR element may be derived from any 3'UTR of a gene or from a variant thereof, such as from a 3'UTR which is naturally associated with the ORF of the artificial nucleic acid molecule according to the present invention or any other 3'UTR of a naturally occurring gene or of a variant thereof.

Preferably, the 3'UTR element is functionally linked to the ORF. This means preferably that the 3'UTR element is associated with the ORF such that it may exert a function, such as a stabilizing function on the expression of the ORF or a stabilizing function on the artificial nucleic acid molecule. Preferably, the ORF and the 3'UTR element are associated in 5'→3' direction. Thus, preferably, the artificial nucleic acid molecule comprises the structure 5'-ORF-(optional)linker-3'UTR element-3', wherein the linker may be present or absent. For example, the linker may be one or more nucleotides, such as a stretch of 1-50 or 1-20 nucleotides, e.g., comprising or consisting of one or more restriction enzyme recognition sites (restriction sites).

Preferably, the at least one 5'UTR element and the at least one 3'UTR element are functionally linked to the ORF. This means preferably that the 5'UTR element and the 3'UTR element are associated with the ORF such that they may exert a function, preferably in an additive, more preferably in a synergistic manner, such as a stabilizing function on the expression of the ORF, a protein production increasing function for the protein encoded by the ORF, or a stabilizing function on the artificial nucleic acid molecule. Preferably, the 5'UTR element, the ORF, and the 3'UTR element are associated in 5'→3' direction. Thus, preferably, the artificial nucleic acid molecule comprises the structure 5'-5'UTR element-(optional)linker-ORF-(optional)linker-3'UTR element-3', wherein the linker may be present or absent. For example, the linker may be one or more nucleotides, such as a stretch of 1-50 or 1-20 nucleotides, e.g., comprising or consisting of one or more restriction enzyme recognition sites (restriction sites).

In a particularly preferred embodiment, the 5'UTR element and the 3'UTR element are heterologous, e.g. preferably the 5'UTR and the 3'UTR are derived from different genes of the same or of different species. Preferably, the 3'UTR is not derived from the TOP gene the 5'UTR is derived from.

In a preferred embodiment, the 3'UTR element is chosen such that it exerts at least an additive, preferably a synergistic function with the 5'UTR element on the protein production from the ORF of the artificial nucleic acid molecule. Preferably, the protein production is increased in at least an additive, preferably a synergistic way by the 3'UTR element and the 5'UTR element. Thus, the protein amount of the protein encoded by the ORF, such as a reporter protein, e.g. luciferase, at a certain time point after initiation of expression of the ORF, e.g. after transfection of a test cell or cell line, is preferably at least the same, preferably higher than what would be expected if the protein production increasing effects of the 3'UTR element and the 5'UTR element were purely additive. The additive, preferably the synergistic effect may, for example, be determined by the following assay. Four artificial nucleic acid molecules, e.g. mRNAs, comprising an ORF encoding, e.g. a reporter protein such as luciferase, are generated, i.e. (i) lacking UTR elements (E0), (ii) containing a 5'UTR element derived from a 5'UTR of a TOP gene or of a variant thereof (E1), (iii) containing a test 3'UTR element (E2), and (iv) containing both the 5'UTR element and the test 3'UTR element (E1E2). Expression of the ORF contained in the artificial nucleic acid molecules is initiated, for example, by transfecting a test cell line, such as a mammalian cell line, e.g. HELA cells, or primary cells, e.g. HDF cells. Samples are taken at specific time points after initiation of expression, for example, after 6 hours, 24 hours, 48 hours, and 72 hours and the amount of protein produced by expression of the ORF contained in the artificial nucleic acid molecules is measured, for example, by an ELISA assay or a luciferase test, depending on the type of protein encoded by the ORF. The predicted amount of protein at a certain time point after initiation of expression obtained by construct E1E2 if the effects of the 3'UTR element and the 5'UTR element were purely additive (PPA) may be calculated as follows:

$$PPA_x=(E1_x-E0_x)+(E2_x-E0_x)+E0_x,$$

E0 is the amount of protein obtained for the construct E0 (lacking UTRs), E1 is the amount of protein obtained for the construct E1, E2 is the protein amount obtained for the construct E2, and x is the time point after initiation of expression. The effect on increasing protein production is additive if $E1E2_x=PPA_x$ and synergistic in the sense of the present invention if $E1E2_x>PPA_x$, wherein $E1E2_x$ is the amount of protein obtained from construct E1E2 at time point x. Preferably, E1E2 is at least 1.0, preferably at least 1.1, more preferably at least 1.3, more preferably at least 1.5, even more preferably at least 1.75 times PPA at a given time point post initiation of expression, such as 24 hours, 48 hours or 72 hours post initiation of expression.

Thus, in a preferred embodiment, the present invention provides an artificial nucleic acid molecule comprising (a.) at least one 5'UTR element which comprises or consists of a nucleic acid sequence which is derived from the 5'UTR of a TOP gene or which is derived from a variant of the 5'UTR of a TOP gene; (b.) at least one open reading frame (ORF); (c.) at least one histone stem-loop, and at least one 3'UTR element, wherein preferably the 3'UTR element and the 5'UTR element act at least additively, preferably synergistically to increase protein production from the ORF, preferably wherein E1E2≥PPA, preferably E1E2 is at least 1.0 times PPA, preferably E1E2 is at least 1.1 times PPA, more preferably E1E2 is at least 1.3 times PPA, even more preferably wherein E1E2 is at least 1.5 times PPA at a given time point post initiation of expression of the ORF, for example 24 hours, preferably 48 hours post initiation of expression, wherein E1E2 and PPA are as described above.

Furthermore, it is preferred that the 3'UTR element and the 5'UTR element have at least an additive, preferably a synergistic effect on the total protein production from the artificial nucleic acid molecule in a certain time span, such as within 24 hours, 48 hours, or 72 hours post initiation of expression. The additive or the synergistic effect may be determined as described above, with the difference that the area under the curve (AUC) for the amount of protein over time predicted for E1E2 if the effects were purely additive is compared to the actual AUC measured for E1E2.

In a preferred embodiment, the 3'UTR element comprises or consists of a nucleic acid sequence which is derived from the 3'UTR of a stable mRNA or from a variant of the 3'UTR of a stable mRNA. Thus, in a preferred embodiment, the 3'UTR element comprises or consists of a sequence which is derived from a gene providing a stable mRNA or from a variant of a 3'UTR of a gene providing a stable mRNA. The term "stable mRNA", preferably refers to mRNAs which exhibit a longer half-life in mammalian cells than the average half-life of mRNA molecules in mammalian cells. Preferably, a stable mRNA in the sense of the present application refers to an mRNA which exhibits a half-life of more than 5 hours, preferably more than 8 hours, in a mammalian cell, such as in a mammalian cell line, e.g. in HELA cells, or in primary cells, e.g. in HDF cells, preferably determined by using a transcription inhibitor such as actinomycin D.

For example, the half-life of an mRNA in mammalian cells, such as HELA or HDF cells, may be determined by culturing the cells in presence of a transcription inhibitor, e.g. actinomycin D, 5,6-dichloro-1-β-D-ribofuranosylbenzimidazole (DRB), or α-amanitin, harvesting the cells at different time points after inhibition of transcription, and determining the amount of the mRNA present in the cell samples by methods well known to the person skilled in the art, e.g. by quantitative RT-PCR. The half-life of a particular mRNA may be calculated based on the amounts of the particular mRNA measured at the different time points post inhibition of transcription. Alternatively, pulse-chase methods, e.g. using radioactively labelled nucleotides, or constructs comprising inducible promoters may be used for determining the half-life of an mRNA in mammalian cells.

It is particularly preferred that the enhanced stability of a stable mRNA in the sense of the present invention is affected by its 3'UTR. Thus, preferably, the 3'UTR element comprises or consists of a nucleic acid sequence which is derived from the 3'UTR of a stable mRNA which exhibits a half-life of more than 5 hours, preferably more than 8 hours, in a mammalian cell, such as in a mammalian cell line, e.g. in HELA cells, or in mammalian primary cells, such as HDF cells, preferably determined by using a transcription inhibitor such as actinomycin D, wherein the enhanced stability of said stable mRNA is effected by its 3'UTR. The ability of a 3'UTR for enhancing stability may be tested as described herein, e.g. by using a reporter open reading frame such as a luciferase encoding open reading frame. Alternatively, an artificial construct encoding the test stable mRNA may be generated, wherein the 3'UTR of the stable mRNA is replaced with a reference 3'UTR, such as a 3'UTR of a short lived mRNA, e.g. a Myc 3'UTR. The stability of the wild type stable mRNA and the 3'UTR modified mRNA may be determined as described above. In the event the 3'UTR modified mRNA exhibits a shorter half-life than the wild type stable mRNA, it may be concluded that a stability enhancing effect is exerted by the 3'UTR of the stable mRNA.

In a particularly preferred embodiment, the 3'UTR element comprises or consists of a nucleic acid sequence which is derived from a 3'UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene, or from a variant of a 3'UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene. In a particularly preferred embodiment, the 3'UTR element comprises or consists of a nucleic acid sequence which is derived from a 3'UTR of an albumin gene, preferably a vertebrate albumin gene, more preferably a mammalian albumin gene, most preferably a human albumin gene. In another particularly preferred embodiment, the 3'UTR element comprises or consists of a nucleic acid sequence which is derived from a 3'UTR of an α-globin gene, preferably a vertebrate α-globin gene, more preferably a mammalian α-globin gene, most preferably a human α-globin gene. For example, the 3'UTR element may comprise or consist of the center, α-complex-binding portion of the 3'UTR of an α-globin gene, such as of a human α-globin gene.

Preferably, the at least one 3'UTR element comprises or consists of a nucleic acid sequence which is derived from the 3'UTR of a vertebrate albumin gene, a vertebrate α-globin gene, a vertebrate β-globin gene, a vertebrate tyrosine hydroxylase gene, a vertebrate lipoxygenase gene, and a vertebrate collagen alpha gene, such as a vertebrate collagen alpha 1(I) gene, or from a variant thereof, preferably from the 3'UTR of a mammalian albumin gene, a mammalian α-globin gene, a mammalian β-globin gene, a mammalian tyrosine hydroxylase gene, a mammalian lipoxygenase gene, and a mammalian collagen alpha gene, such as a mammalian collagen alpha 1(I) gene, or from a variant thereof, more preferably from the 3'UTR of a human albumin gene, a human α-globin gene, a human β-globin gene, a human tyrosine hydroxylase gene, a human lipoxygenase gene, and a human collagen alpha gene, such as a human collagen alpha 1(I) gene, or from a variant thereof, even more preferably from the 3'UTR of the human albumin gene according to GenBank Accession number NM_000477.5 or from a variant thereof. In a preferred embodiment, the 3'UTR element is not derived from the 3'UTR of a *Xenopus* albumin gene. Preferably, the 3'UTR element does not comprise a poly(A) limiting element B (PLEB) of a 3'UTR from a *Xenopus* albumin gene. Preferably, the 3'UTR element does not consist of a PLEB of a 3'UTR from a *Xenopus* albumin gene.

In one embodiment, the 3'UTR element and the at least one open reading frame are heterologous, e.g. preferably the 3'UTR element and the ORF are derived from different genes of the same or of different species. Preferably, the ORF does not encode an α-globin protein if the 3'UTR element is derived from an α-globin gene. Preferably, the ORF does not encode a β-globin protein if the 3'UTR element is derived from a β-globin gene. Preferably, the ORF does not encode an albumin protein if the 3'UTR element is derived from an albumin gene. Preferably, the ORF does not encode a tyrosine hydroxylase protein if the 3'UTR element is derived from a tyrosine hydroxylase gene. Preferably, the ORF does not encode a lipoxygenase protein if the 3'UTR element is derived from a lipoxygenase gene. Preferably, the ORF does not encode a collagen alpha protein if the 3'UTR element is derived from a collagene alpha gene.

In one embodiment, the artificial nucleic acid molecule may consist of at least two sequence parts that are derivable from two different genes, the 5'UTR element which is derivable from a TOP gene and the open reading frame and the 3'UTR which may be derivable from the gene encoding the desired protein product. More preferably, the artificial nucleic acid molecule consists of three sequence parts that are derivable from three different genes: the 5'UTR element which is derivable from a TOP gene, the open reading frame which is derivable from the gene encoding the desired gene product and the 3'UTR element which may be derivable from a gene that relates to an mRNA with an enhanced half-life, for example a 3'UTR element as defined and described below.

In some embodiments, the 3'UTR element consists of a histone stem-loop. In some embodiments, the 3'UTR element of the artificial nucleic acid molecule may comprise a histone stem-loop in addition to the nucleic acid sequence derived from the 3'UTR of a gene, such as of a gene providing a stable mRNA, such as of an albumin gene, an α-globin gene, a β-globin gene, a tyrosine hydroxylase gene, a lipoxygenase gene, or a collagen alpha gene, or a collagen alpha 1(I) gene as described above. Such artificial nucleic acid molecule according to the present invention, for example, may comprise in 5'-to-3'-direction a 5'UTR element, an ORF, a 3'UTR element, preferably comprising a polyadenylation signal, a histone stem-loop and an optional poly(A) sequence. It may also comprise in 5'-to-3'-direction a 5'UTR element as described above, an ORF, a 3'UTR element, e.g. comprising a polyadenylation signal, a poly(A) sequence and a histone stem-loop.

The term 'a nucleic acid sequence which is derived from the 3'UTR of a [ . . . ] gene' preferably refers to a nucleic acid sequence which is based on the 3'UTR sequence of a [ . . . ] gene or on a part thereof, such as on the 3'UTR of an albumin gene, an α-globin gene, a β-globin gene, a tyrosine hydroxylase gene, a lipoxygenase gene, or a collagen alpha gene, such as a collagen alpha 1(I) gene, preferably of an albumin gene or an α-globin gene on a part thereof. This term includes sequences corresponding to the entire 3'UTR sequence, i.e. the full length 3'UTR sequence of a gene, and sequences corresponding to a fragment of the 3'UTR sequence of a gene, such as an albumin gene, α-globin gene, β-globin gene, tyrosine hydroxylase gene, lipoxygenase gene, or collagen alpha gene, such as a collagen alpha 1(I) gene, preferably of an albumin or α-globin gene. A fragment in this context preferably consists of a continuous stretch of nucleotides corresponding to a continuous stretch of nucleotides in the full-length 3'UTR, which represents at least 20%, preferably at least 30%, more preferably at least 40%, more preferably at least 50%, even more preferably at least 60%, even more preferably at least 70%, even more preferably at least 80%, and most preferably at least 90% of the full-length 3'UTR. Such a fragment, in the sense of the present invention, is preferably a functional fragment as described herein. The term '3'UTR of a [ . . . ] gene' preferably refers to the 3'UTR of a naturally occurring gene, such as of a naturally occurring albumin gene, α-globin gene, β-globin gene, tyrosine hydroxylase gene, lipoxygenase gene, or collagen alpha gene, such as a collagen alpha 1 (I) gene, preferably of a naturally occurring albumin or α-globin gene.

The terms 'variant of the 3'UTR of a [ . . . ] gene' and 'variant thereof' in the context of a 3'UTR refers to a variant of the 3'UTR of a naturally occurring gene, such as a naturally occurring albumin gene, a naturally occurring α-globin gene, a naturally occurring β-globin gene, a naturally occurring tyrosine hydroxylase gene, a naturally occurring lipoxygenase gene, or a naturally occurring collagen alpha gene, such as a collagen alpha 1(I) gene, preferably to a variant of the 3'UTR of a vertebrate albumin gene, a vertebrate α-globin gene, a vertebrate β-globin gene, a vertebrate tyrosine hydroxylase gene, a vertebrate lipoxygenase gene, and a vertebrate collagen alpha gene, such as a vertebrate collagen alpha 1(I) gene, preferably to a variant of the 3'UTR of a mammalian albumin gene, a mammalian α-globin gene, a mammalian β-globin gene, a mammalian tyrosine hydroxylase gene, a mammalian lipoxygenase gene, and a mammalian collagen alpha gene, such as a mammalian collagen alpha 1(I) gene, or to a variant of the 3'UTR of a human albumin gene, a human α-globin gene, a human β-globin gene, a human tyrosine hydroxylase gene, a human lipoxygenase gene, and a human collagen alpha gene, such as a human collagen alpha 1(I) gene. Such variant may be a modified 3'UTR of a gene. For example, a variant 3'UTR may exhibit one or more nucleotide deletions, insertions, additions and/or substitutions compared to the naturally occurring 3'UTR from which the variant is derived. Preferably, a variant of a 3'UTR is at least 40%, preferably at least 50%, more preferably at least 60%, more preferably at least 70%, even more preferably at least 80%, even more preferably at least 90%, most preferably at least 95% identical to the naturally occurring 3'UTR the variant is derived from. Preferably, the variant is a functional variant as described herein.

The term 'a nucleic acid sequence which is derived from a variant of the 3'UTR of a [ . . . ] gene' preferably refers to a nucleic acid sequence which is based on a variant of the 3'UTR sequence of a gene, such as on a variant of the 3'UTR of an albumin gene, an α-globin gene, a β-globin gene, a tyrosine hydroxylase gene, a lipoxygenase gene, or a collagen alpha gene, such as a collagen alpha 1(I) gene, or on a part thereof as described above. This term includes sequences corresponding to the entire sequence of the variant of the 3'UTR of a gene, i.e. the full length variant 3'UTR sequence of a gene, and sequences corresponding to a fragment of the variant 3'UTR sequence of a gene. A fragment in this context preferably consists of a continuous stretch of nucleotides corresponding to a continuous stretch of nucleotides in the full-length variant 3'UTR, which represents at least 20%, preferably at least 30%, more preferably at least 40%, more preferably at least 50%, even more preferably at least 60%, even more preferably at least 70%, even more preferably at least 80%, and most preferably at least 90% of the full-length variant 3'UTR. Such a fragment of a variant, in the sense of the present invention, is preferably a functional fragment of a variant as described herein.

The terms 'functional variant', 'functional fragment', and 'functional fragment of a variant' (also termed 'functional variant fragment') in the context of the present invention, mean that the fragment of the 5'UTR or the 3'UTR, the variant of the 5'UTR or the 3'UTR, or the fragment of a variant of the 5'UTR or the 3'UTR of a gene fulfils at least one, preferably more than one, function of the naturally occurring 5'UTR or 3'UTR of the gene of which the variant, the fragment, or the fragment of a variant is derived. Such function may be, for example, stabilizing mRNA and/or stabilizing and/or prolonging protein production from an mRNA and/or increasing protein production from an mRNA, preferably in a mammalian cell, such as in a human cell. It is particularly preferred that the variant, the fragment, and the variant fragment in the context of the present invention fulfil the function of stabilizing an mRNA, preferably in a mammalian cell, such as a human cell, compared to an mRNA comprising a reference 5'UTR or lacking a 5'UTR and/or a 3'UTR, and/or the function of stabilizing and/or prolonging protein production from an mRNA, preferably in a mammalian cell, such as in a human cell, compared to an mRNA comprising a reference 5'UTR or lacking a 5'UTR and/or a 3'UTR, and/or the function of increasing protein production from an mRNA, preferably in a mammalian cell, such as in a human cell, compared to an mRNA comprising a reference 5'UTR or lacking a 5'UTR and/or a 3'UTR. A reference 5'UTR may be, for example, a 5'UTR naturally occurring in combination with the ORF. Furthermore, a functional variant, a functional fragment, or a functional variant fragment of a 5'UTR or of a 3'UTR of a gene preferably does not have a substantially diminishing effect on the efficiency of translation of the mRNA which comprises such variant of a 5'UTR and/or such variant of a 3'UTR compared to the wild type 5'UTR and/or 3'UTR from which the variant is derived. A particularly preferred function of a "functional fragment", a "functional variant" or a "functional fragment of a variant" of the 3'UTR of a gene, such as an albumin gene, α-globin gene, β-globin gene, tyrosine hydroxylase gene, lipoxygenase gene, or collagen alpha gene, such as a collagen alpha 1(I) gene, in the context of the present invention is the stabilization and/or prolongation of protein production by expression of an mRNA carrying the functional fragment, functional variant or functional fragment of a variant as described above. A particularly preferred function of a "functional fragment", a "functional variant" or a "functional fragment of a variant" of the 5'UTR in the context of the present invention is the protein production increasing function.

Preferably, the efficiency of the one or more functions exerted by the functional variant, the functional fragment, or the functional variant fragment, such as mRNA and/or protein production stabilizing efficiency and/or the protein production increasing efficiency, is at least 40%, more preferably at least 50%, more preferably at least 60%, even more preferably at least 70%, even more preferably at least 80%, most preferably at least 90% of the mRNA and/or protein production stabilizing efficiency and/or the protein production increasing efficiency exhibited by the naturally occurring 5'UTR and/or 3'UTR of which the variant, the fragment or the variant fragment is derived.

In the context of the present invention, a fragment or part of the 3'UTR of a gene, such as an albumin gene, α-globin gene, β-globin gene, tyrosine hydroxylase gene, lipoxygenase gene, or collagen alpha gene, such as a collagen alpha 1(I) gene, or of a variant thereof preferably exhibits a length of at least about 40 nucleotides, preferably of at least about 50 nucleotides, preferably of at least about 75 nucleotides, more preferably of at least about 100 nucleotides, even more preferably of at least about 125 nucleotides, most preferably of at least about 150 nucleotides. Preferably, such fragment of the 3'UTR of a gene or of a variant of the 3'UTR of a gene is a functional fragment as described above.

In the context of the present invention, a fragment or part of the 5'UTR of a TOP gene or of a variant thereof preferably exhibits a length of at least about 20 nucleotides, preferably of at least about 30 nucleotides, more preferably of at least about 50 nucleotides. Preferably, such fragment of the 5'UTR of a TOP gene or of a variant of the 5'UTR of a TOP gene is a functional fragment as described above.

In some embodiments, the 3'UTR element of the artificial nucleic acid molecule according to the present invention comprises or consists of a "functional fragment", a "functional variant" or a "functional fragment of a variant" of the 3'UTR of a gene, such as of an albumin gene, α-globin gene, β-globin gene, tyrosine hydroxylase gene, lipoxygenase gene, or collagen alpha gene, such as a collagen alpha 1(I) gene, or of a variant thereof.

In some embodiments, the at least one 5'UTR element of the artificial nucleic acid molecule according to the present invention comprises or consists of a "functional fragment", a "functional variant" or a "functional fragment of a variant" of the 5'UTR of a TOP gene.

Preferably, the 3'UTR element of the artificial nucleic acid molecule according to the present invention increases the stability of the artificial nucleic acid molecule, e.g. increases the stability of an mRNA according to the present invention, compared to a respective mRNA (reference mRNA) lacking a 3'UTR element. Preferably, the at least one 3'UTR element of the artificial nucleic acid molecule according to the present invention increases the stability of protein production from the artificial nucleic acid molecule according to the present invention, e.g. from an mRNA according to the present invention, compared to a respective mRNA lacking a 3'UTR element. Preferably, the at least one 3'UTR element of the artificial nucleic acid molecule according to the present invention prolongs protein production from the artificial nucleic acid molecule according to the present invention, e.g. from an mRNA according to the present invention, compared to a respective mRNA lacking a 3'UTR element. Preferably, the at least one 3'UTR element of the artificial nucleic acid molecule according to the present invention increases the protein production from the artificial nucleic acid molecule according to the present invention, e.g. from an mRNA according to the present invention, compared to a respective mRNA lacking a 3'UTR element. Preferably, the at least one 3'UTR element of the artificial nucleic acid molecule according to the present invention does not negatively influence translational efficiency of an mRNA compared to the translational efficiency of a respective mRNA lacking a 3'UTR element. The term 'respective mRNA' in this context means that—apart from the different 3'UTR—the reference mRNA is comparable, preferably identical, to the mRNA comprising the 3'UTR element.

Preferably, the at least one 5'UTR element of the artificial nucleic acid molecule according to the present invention increases the stability of the artificial nucleic acid molecule, e.g. increases the stability of an mRNA according to the present invention, compared to a respective mRNA (reference mRNA) lacking a 5'UTR element or comprising a reference 5'UTR element, such as a 5'UTR naturally occurring in combination with the ORF. Preferably, the at least one 5'UTR element of the artificial nucleic acid molecule according to the present invention increases protein production from the artificial nucleic acid molecule according to the present invention, e.g. from an mRNA according to the present invention, compared to a respective mRNA lacking a 5'UTR element or comprising a reference 5'UTR element, such as a 5'UTR naturally occurring in combination with the ORF. The term 'respective mRNA' in this context means that—apart from the different 5'UTR—the reference mRNA is comparable, preferably identical, to the mRNA comprising the inventive 5'UTR element.

Preferably, the histone stem-loop of the artificial nucleic acid molecule according to the present invention increases the stability of the artificial nucleic acid molecule, e.g. increases the stability of an mRNA according to the present invention, compared to a respective mRNA (reference mRNA) lacking a histone stem-loop. Preferably, the histone stem-loop of the artificial nucleic acid molecule according to the present invention increases protein production from the artificial nucleic acid molecule according to the present invention, e.g. from an mRNA according to the present invention, compared to a respective mRNA lacking a histone stem-loop. The term 'respective mRNA' in this context means that—apart from the histone stem loop—the reference mRNA is comparable, preferably identical, to the mRNA comprising the a histone stem-loop.

Preferably, the at least one 5'UTR element and the at least one 3'UTR element act synergistically to increase protein production from the artificial nucleic acid molecule according to the present invention, e.g. from an mRNA according to the present invention, as described above.

Preferably, the at least one 5'UTR element and the histone stem-loop act synergistically to increase protein production from the artificial nucleic acid molecule according to the present invention, e.g. from an mRNA according to the present invention, as described above.

The term 'stabilizing and/or prolonging protein production from an mRNA' preferably means that the protein production from the mRNA is stabilized and/or prolonged compared to the protein production from a reference mRNA, e.g. lacking a 3'UTR element.

'Stabilized protein expression' in this context preferably means that there is more uniform protein production from the artificial nucleic acid molecule according to the present invention over a predetermined period of time, such as over 24 hours, more preferably over 48 hours, even more preferably over 72 hours, when compared to a reference nucleic acid molecule, for example, lacking a 3'UTR element. Thus, the level of protein production, e.g. in a mammalian system, from the artificial nucleic acid molecule comprising a 3'UTR element according to the present invention, e.g. from an mRNA according to the present invention, preferably does not drop to the extent observed for a reference nucleic acid molecule. For example, the amount of a protein (encoded by the ORF) observed 6 hours after initiation of expression, e.g. 6 hours post transfection of the artificial nucleic acid molecule according to the present invention into a cell, such as a mammalian cell, may be comparable to the amount of protein observed 48 hours after initiation of expression, e.g. 48 hours post transfection. Thus, the ratio of the amount of protein encoded by the ORF, such as of a reporter protein, e.g., luciferase, observed at 48 hours post initiation of expression, e.g. 48 hours post transfection, to the amount of protein observed 6 hours after initiation of expression, e.g. 6 hours post transfection, is preferably above 0.4, preferably above 0.5, more preferably above 0.6, even more preferably above 0.7, e.g. between about 0.4 and about 4, preferably between about 0.65 and about 3, more preferably between about 0.7 and 2 for a nucleic acid molecule according to the present invention. Thus, in one embodiment, the present invention provides an artificial nucleic acid molecule as described above, wherein the ratio of the (reporter) protein amount observed 48 hours after initiation of expression to the (reporter) protein amount observed 6 hours after initiation of expression, preferably in a mammalian expression system, such as in mammalian cells, is preferably between about 0.4 and 4, preferably between about 0.65 and about 3, more preferably between about 0.7 and 2.

'Increased protein expression' in the context of the present invention may refer to increased protein expression at one time point after initiation of expression compared to a reference molecule or to an increased total protein production within a certain time period after initiation of expression. Thus, the protein level observed at a certain time point after initiation of expression, e.g. after transfection, of the artificial nucleic acid molecule according to the present invention, e.g. after transfection of an mRNA according to the present invention, for example, 24, 48, or 72 hours post transfection, or the total protein produced in a time span of, e.g. 24, 48 or 72 hours, is preferably higher than the protein level observed at the same time point after initiation of expression, e.g. after transfection, or the total protein produced within the same time span, for a reference nucleic acid molecule, such as a reference mRNA comprising a reference 5'UTR element or lacking a 5'UTR element and/or 3'UTR element and/or a histone stem-loop. As set forth above, it is a particularly preferred function of the 5'UTR element and the histone stem-loop to effect an increase in protein production from the artificial nucleic acid molecule. Preferably, the increase in protein production effected by the 5'UTR element and the histone stem-loop compared to a reference nucleic acid molecule lacking such 5'UTR element and a histone stem-loop at a given time point post initiation of expression is at least 1.5-fold, more preferably at least 2-fold, more preferably at least 3-fold, more preferably at least 4-fold, more preferably at least 5-fold, even more preferably at least 10-fold, even more preferably at least 15-fold of the protein production observed for a reference nucleic acid molecule lacking the 5'UTR element and a histone stem-loop. The same holds preferably for the total protein production in a given time period, for example in a time period of 24, 48 or 72 hours post initiation of expression.

Said increase in stability of the artificial nucleic acid molecule, said increase in stability of protein production, said prolongation of protein production and/or said increase in protein production is preferably determined by comparison with a respective reference nucleic acid molecule lacking a 5'UTR element and/or a 3'UTR element and/or a histone stem-loop, e.g. an mRNA lacking a 5'UTR element and/or a 3'UTR element and/or a histone stem-loop, or a reference nucleic acid molecule comprising a reference 5'UTR element and/or a reference 3'UTR element, such as a 3'UTR and/or a 5'UTR naturally occurring with the ORF or a 5'UTR and/or a 3'UTR of a reference gene.

The mRNA and/or protein production stabilizing effect and efficiency and/or the protein production increasing effect and efficiency of the variants, fragments and/or variant fragments of the 3'UTR of an albumin gene as well as the mRNA and/or protein production stabilizing effect and efficiency and/or the protein production increasing effect and efficiency of the 3'UTR element, the at least one 5'UTR element, or the histone stem-loop of the artificial nucleic acid molecule according to the present invention may be determined by any method suitable for this purpose known to the skilled person. For example, artificial mRNA molecules may be generated comprising a coding sequence for a reporter protein, such as luciferase, and no 3'UTR and/or no 5'UTR and/or no histone stem-loop, a 5'UTR derived from a TOP gene and/or a 3'UTR derived from a gene as described above and/or a histone stem-loop as described above, a 5'UTR derived from a reference gene and/or a 3'UTR derived from a reference gene (i.e., a reference 3'UTR or a reference 5'UTR, such as a 5'UTR or a 3'UTR naturally occurring with the ORF), as 3'UTR a variant of a 3'UTR of a gene as described above, as 3'UTR a fragment of a 3'UTR of a gene as described above, or as 3'UTR a fragment of a variant of a 3'UTR of a gene as described above, as 5'UTR a variant of a 5'UTR of a TOP gene, as 5'UTR a fragment of a 5'UTR of a TOP gene, or as 5'UTR a fragment of a variant of a 5'UTR of a TOP gene. Such mRNAs may be generated, for example, by in vitro transcription of respective vectors such as plasmid vectors, e.g. comprising a T7 promoter and a sequence encoding the respective mRNA sequences. The generated mRNA molecules may be transfected into cells by any transfection method suitable for transfecting mRNA, for example they may be electroporated into mammalian cells, such as HELA or HDF cells, and samples may be analyzed certain time points after transfection, for example, 6 hours, 24 hours, 48 hours, and 72 hours post transfection. Said samples may be analyzed for mRNA quantities and/or protein quantities by methods well known to the skilled person. For example, the quantities of reporter mRNA present in the cells at the sample time points may be determined by quantitative PCR methods. The quantities of reporter protein encoded by the respective mRNAs may be determined, e.g., by ELISA assays or reporter assays such as luciferase assays depending on the reporter protein used. The effect of stabilizing protein expression and/or prolonging protein expression may be, for example, analyzed by determining the ratio of the protein level observed 48 hours post transfection and the protein level observed 6 hours post transfection. The closer said value is to 1, the more stable the protein expression is within this time period. Said value may also be above 1 if the protein level is higher at the later time point. Such measurements may of course also be performed at 72 or more hours and the ratio of the protein level observed 72 hours post transfection and the protein level observed 6 hours post transfection may be determined to determine stability of protein expression.

Preferably, the 3'UTR element of the artificial nucleic acid molecule according to the present invention comprises or consists of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99%, most preferably of 100% to a nucleic acid sequence selected from SEQ ID NOs. 1369-1377 and 1434 and corresponding RNA sequences, wherein the variants of the sequences according to SEQ ID NOs. 1369-1377 and 1434 are preferably functional variants as described above. SEQ ID NOs. 1369, 1371 and 1434, variants thereof, and corresponding RNA sequences are particularly preferred.

The 3'UTR element of the artificial nucleic acid molecule according to the present invention may also comprise or consist of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99%, most preferably of 100% to the nucleic acid sequence according to SEQ ID No. 1369-1377 and 1434 and of corresponding RNA sequences, wherein the fragment is preferably a functional fragment or a functional variant fragment as described above. Preferably, the fragment is as described above, i.e. being a continuous stretch of nucleotides representing at least 20% etc. of the full-length 3'UTR the fragment is derived from. Such fragment preferably exhibits a length of at least about 40 nucleotides, preferably of at least about 50 nucleotides, preferably of at least about 75 nucleotides, more preferably of at least about 100 nucleotides, even more preferably of at least about 125 nucleotides, most preferably of at least about 150 nucleotides.

For example, such fragment may exhibit a nucleic acid sequence according to SEQ ID Nos. 1378-1390, such as:

```
                                            (SEQ ID No. 1378)
AAAAGCATCT CAGCCTACCA TGAGAATAAG AGAAAGAAAA
TGAAGATCAA AAGCTTATTC ATCTGTTTTT CTTTTTCGTT
GGTGTAAAGC CAACACCCTG TCTAAAAAAC ATAAATTTCT
TTAATCATTT TGCCTCTTTT CTCTGTGCTT CAATT (SEQ ID No. 1379)
CATCACATTT AAAAGCATCT CAGCCTACCA TGAGAATAAG
AGAAAGAAAA TGAAGATCAA AAGCTTATTC ATCTGTTTTT
CTTTTTCGTT GGTGTAAAGC CAACACCCTG (SEQ ID No. 1380)
AAAAGCATCT CAGCCTACCA TGAGAATAAG AGAAAGAAAA
TGAAGATCAA AAGCTTATTC ATCTGTTTTT CTTTTTCGTT
GGTGTAAAGC CAACACCCTG TCTAAAAAAC (SEQ ID No. 1381)
CAGCCTACCA TGAGAATAAG AGAAAGAAAA TGAAGATCAA
AAGCTTATTC ATCTGTTTTT CTTTTTCGTT GGTGTAAAGC
CAACACCCTG TCTAAAAAAC ATAAATTTCT (SEQ ID No. 1382)
TGAGAATAAG AGAAAGAAAA TGAAGATCAA AAGCTTATTC
ATCTGTTTTT CTTTTTCGTT GGTGTAAAGC CAACACCCTG
TCTAAAAAAC ATAAATTTCT TTAATCATTT (SEQ ID No. 1383)
AGAAAGAAAA TGAAGATCAA AAGCTTATTC ATCTGTTTTT
CTTTTTCGTT GGTGTAAAGC CAACACCCTG TCTAAAAAAC
ATAAATTTCT TTAATCATTT TGCCTCTTTT (SEQ ID No. 1384)
TGAAGATCAA AAGCTTATTC ATCTGTTTTT CTTTTTCGTT
GGTGTAAAGC CAACACCCTG TCTAAAAAAC ATAAATTTCT
TTAATCATTT TGCCTCTTTT CTCTGTGCTT (SEQ ID No. 1385)
AAGCTTATTC ATCTGTTTTT CTTTTTCGTT GGTGTAAAGC
CAACACCCTG TCTAAAAAAC ATAAATTTCT TTAATCATTT
TGCCTCTTTT CTCTGTGCTT CAATTAATAA (SEQ ID No. 1386)
ATCTGTTTTT CTTTTTCGTT GGTGTAAAGC CAACACCCTG
TCTAAAAAAC ATAAATTTCT TTAATCATTT TGCCTCTTTT
CTCTGTGCTT CAATTAATAA AAAATGGAAA (SEQ ID No. 1387)
CAGCCTACCA TGAGAATAAG AGAAAGAAAA TGAAGATCAA
AAGCTTATTC ATCTGTTTTT CTTTTTCGTT GGTGTAAAGC
CAACACCCTG TCTAAAAAAC ATAAATTTCT TTAATCATTT
TGCCTCTTTT CTCTGTGCTT CAATTAATAA A (SEQ ID No. 1388)
TGAAGATCAA AAGCTTATTC ATCTGTTTTT CTTTTTCGTT
GGTGTAAAGC CAACACCCTG TCTAAAAAAC ATAAATTTCT
TTAATCATTT TGCCTCTTTT CTCTGTGCTT CAATTAATAA
A (SEQ ID No. 1389)
CTTTTTCGTT GGTGTAAAGC CAACACCCTG TCTAAAAAAC
ATAAATTTCT TTAATCATTT TGCCTCTTTT CTCTGTGCTT
CAATTAATAA A (SEQ ID No. 1390)
AAGCTTATTC ATCTGTTTTT CTTTTTCGTT GGTGTAAAGC
CAACACCCTG TCTAAAAAAC
``` or the corresponding RNA sequence, or a nucleic acid sequence which is at least 40%, preferably at least about 50%, preferably at least about 60%, preferably at least about 70%, more preferably at least about 80%, more preferably at least about 90%, even more preferably at least about 95%, even more preferably at least about 99% identical to said nucleic acid sequences or the corresponding RNA sequence. Thus, the at least one 3'UTR element of the artificial nucleic acid molecule according to the present invention may comprise or consist of a nucleic acid fragment as described above. Obviously, the thymidine nucleotides comprised in the fragments according to SEQ ID Nos. 1378-1390 may be replaced by uridine nucleotides.

Preferably, said variants, fragments or variant fragments are functional variants, functional fragments, or functional variant fragments as described above, exhibiting at least one function of the nucleic acid sequence according to SEQ ID Nos. 1369-1377 and 1434, such as stabilization of the artificial nucleic acid molecule according to the invention, stabilizing and/or prolonging protein expression from the artificial nucleic acid molecule according to the invention, and/or increasing protein production, preferably with an efficiency of at least 40%, more preferably of at least 50%, more preferably of at least 60%, even more preferably of at least 70%, even more preferably of at least 80%, most preferably of at least 90% of the stabilizing efficiency and/or protein production increasing efficiency exhibited by the nucleic acid sequence according to SEQ ID Nos. 1369-1377 and 1434. Preferably, variants, fragments or variant fragments are functional variants, functional fragments, or functional variant fragments exhibit the function of acting synergistically with the 5'UTR element to increase protein production from the artificial nucleic acid molecule.

Preferably, the 3'UTR element of the artificial nucleic acid molecule according to the present invention exhibits a length of at least about 40 nucleotides, preferably of at least about 50 nucleotides, preferably of at least about 75 nucleotides, more preferably of at least about 100 nucleotides, even more preferably of at least about 125 nucleotides, most preferably of at least about 150 nucleotides. For example, the 3'UTR may exhibit a length of about 50 to about 300 nucleotides, preferably of about 100 to about 250 nucleotides, more preferably of about 150 to about 200 nucleotides.

Furthermore, the artificial nucleic acid molecule according to the present invention may comprise more than one 3'UTR elements as described above. For example, the artificial nucleic acid molecule according to the present invention may comprise one, two, three, four or more 3'UTR elements, wherein the individual 3'UTR elements may be the same or they may be different. For example, the artificial nucleic acid molecule according to the present invention may comprise two essentially identical 3'UTR elements as described above, e.g. two 3'UTR elements comprising or consisting of a nucleic acid sequence which is derived from the 3'UTR of an albumin gene or an α-globin gene or from a variant of the 3'UTR of an albumin gene or of an α-globin gene, such as a nucleic acid sequence according to SEQ ID No. 1369, 1371, 1376, or 1434, functional variants thereof, functional fragments thereof, or functional variant fragments thereof as described above.

In a preferred embodiment, the artificial nucleic acid molecule comprises (a.) at least one 5'UTR element which comprises or consists of a nucleic acid sequence which is derived from the 5'UTR of a TOP gene encoding a ribosomal protein as described above, for example, encoding a ribosomal Large protein, or from a variant thereof, (b.) at least one open reading frame, (c.) at least one histone stem-loop as described herein, such as at least one histone stem-loop according to SEQ ID NOs. 1391-1433, optionally (d.) a poly(A) sequence or a poly(A) signal, optionally (e.) a poly(C) sequence, and optionally (f.) at least one 3'UTR element, preferably derived from a gene providing a stable mRNA, e.g., which comprises or consists of a nucleic acid sequence which is derived from the 3'UTR of an albumin gene or an α-globin gene, such as a sequence selected from the group consisting of SEQ ID NOs: 1369, 1371, and 1434 or a variant thereof as described herein.

Preferably, the sequence of elements of the artificial nucleic acid molecule in 5'-to-3'-direction is 5'-[at least one 5'UTR]-[ORF]-[optional at least one 3'UTR]-[optional poly (A) sequence]-[optional poly(C) sequence]-[at least one histone stem-loop]-3'.

In a particularly preferred embodiment, the artificial nucleic acid molecule comprises (a.) at least one 5'UTR element which comprises or consists of a nucleic acid sequence which is derived from the 5'UTR of a ribosomal protein Large 32 gene (RPL32), a ribosomal protein Large 35 gene (RPL35), a ribosomal protein Large 21 gene (RPL21), an ATP synthase, H+ transporting, mitochondrial F1 complex, alpha subunit 1, cardiac muscle (ATP5A1) gene, an hydroxysteroid (17-beta) dehydrogenase 4 gene (HSD17B4), an androgen-induced 1 gene (AIG1), cytochrome c oxidase subunit VIc gene (COX6C), or a N-acylsphingosine amidohydrolase (acid ceramidase) 1 gene (ASAH1) or from a variant thereof, preferably from a vertebrate ribosomal protein Large 32 gene (RPL32), a vertebrate ribosomal protein Large 35 gene (RPL35), a vertebrate ribosomal protein Large 21 gene (RPL21), a vertebrate ATP synthase, H+ transporting, mitochondrial F1 complex, alpha subunit 1, cardiac muscle (ATP5A1) gene, a vertebrate hydroxysteroid (17-beta) dehydrogenase 4 gene (HSD17B4), a vertebrate androgen-induced 1 gene (AIG1), a vertebrate cytochrome c oxidase subunit VIc gene (COX6C), or a vertebrate N-acylsphingosine amidohydrolase (acid ceramidase) 1 gene (ASAH1) or from a variant thereof, more preferably from a mammalian ribosomal protein Large 32 gene (RPL32), a ribosomal protein Large 35 gene (RPL35), a ribosomal protein Large 21 gene (RPL21), a mammalian ATP synthase, H+ transporting, mitochondrial F1 complex, alpha subunit 1, cardiac muscle (ATP5A1) gene, a mammalian hydroxysteroid (17-beta) dehydrogenase 4 gene (HSD17B4), a mammalian androgen-induced 1 gene (AIG1), a mammalian cytochrome c oxidase subunit VIc gene (COX6C), or a mammalian N-acylsphingosine amidohydrolase (acid ceramidase) 1 gene (ASAH1) or from a variant thereof, most preferably from a human ribosomal protein Large 32 gene (RPL32), a human ribosomal protein Large 35 gene (RPL35), a human ribosomal protein Large 21 gene (RPL21), a human ATP synthase, H+ transporting, mitochondrial F1 complex, alpha subunit 1, cardiac muscle (ATP5A1) gene, a human hydroxysteroid (17-beta) dehydrogenase 4 gene (HSD17B4), a human androgen-induced 1 gene (AIG1), a human cytochrome c oxidase subunit VIc gene (COX6C), or a human N-acylsphingosine amidohydrolase (acid ceramidase) 1 gene (ASAH1) or from a variant thereof, wherein preferably the 5'UTR element does not comprise the 5'TOP of said gene, such as the sequence according to SEQ ID NO: 1368 or SEQ ID NOs 1452-1460 or a variant thereof, (b.) at least one open reading frame, (c.) at least one histone stem-loop, such as at least one histone stem-loop according to SEQ ID NOs. 1391-1433, optionally (d.) a poly(A) sequence and/or a poly(A) signal, optionally (e.) a poly(C) sequence, and optionally (f.) at least one 3'UTR element which comprises or consists of a nucleic acid sequence which is derived from an albumin gene or an α-globin gene, such as a sequence selected from the group consisting of SEQ ID NOs: 1369, 1371, and 1434 or a variant thereof as described herein.

In a particularly preferred embodiment, the artificial nucleic acid molecule according to the present invention comprises:

(a.) at least one 5'UTR element which comprises or consists of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID No. 1368 or SEQ ID NOs. 1452-1460, or a corresponding RNA sequence, (b.) at least one open reading frame, (c.) at least one histone stem-loop as described herein, such as a histone stem-loop sequence according to any one of SEQ ID NOs. 1391-1433, preferably a histone stem-loop sequence having a sequence identity of at least about 75%, preferably of at least about 80%, preferably at least about 85%, more preferably at least about 90%, even more preferably at least about 95% to the sequence according to SEQ ID NO. 1433 or a corresponding RNA sequence, wherein preferably positions 6, 13 and 20 of the sequence having a sequence identity of at least about 75%, preferably of at least about 80%, preferably at least about 85%, more preferably at least about 90%, even more preferably at least about 95% to the sequence according to SEQ ID NO. 1433 or the corresponding RNA sequence are conserved, i.e. are identical to the nucleotides at positions 6, 13 and 20 of SEQ ID NO. 1433,
(d.) optionally, a poly(A) sequence or a poly(A) signal as described herein,
(e.) optionally, a poly(C) sequence, and
(f.) optionally, a 3'UTR element, preferably a 3'UTR element which is derived from a gene providing a stable mRNA, such as a 3'UTR element which comprises or consists of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99%, most preferably of 100% to the nucleic acid sequence according to SEQ ID No. 1369, 1371, or 1434 or a corresponding RNA sequence.

Thus, in a particularly preferred embodiment, the present invention provides an artificial nucleic acid molecule comprising a 5'UTR element which comprises or consists of a nucleic acid sequence which has an identity of at least about 90% to the nucleic acid sequence according to SEQ ID No. 1368 or SEQ ID NOs. 1452-1460, or a corresponding RNA sequence, a histone stem-loop comprising a sequence which has an identity of at least about 90% to the sequence according to SEQ ID NO. 1434 or a corresponding RNA sequence, optionally a poly(A) sequence and/or a poly(A) signal as described herein, optionally a poly(C) sequence, and optionally a 3'UTR element which comprises or consists of a nucleic acid sequence which has an identity of at least about 90% to the nucleic acid sequence according to SEQ ID No. 1369, 1371 or 1434.

Preferably, the artificial nucleic acid molecule according to the present invention does not contain one or two or at least one or all but one or all of the components of the group consisting of: a sequence encoding a ribozyme (preferably a self-splicing ribozyme), a viral nucleic acid sequence, a histone stem-loop processing signal, in particular a histone stem-loop processing sequence derived from mouse histon H2A614 gene, a Neo gene, an inactivated promoter sequence and an inactivated enhancer sequence. Even more preferably, the nucleic acid according to the invention does not contain a ribozyme, preferably a self-splicing ribozyme, and one of the group consisting of: a Neo gene, an inactivated promotor sequence, an inactivated enhancer sequence, a histon stem-loop processing signal, in particular a histonstem loop processing sequence derived from mouse histon H2A614 gene. Accordingly, the nucleic acid may in a preferred mode neither contain a ribozyme, preferably a self-splicing ribozyme, nor a Neo gene or, alternatively, neither a ribozyme, preferably a self-splicing ribozyme, nor any resistance gene (e.g. usually applied for selection). In another preferred mode, the nucleic acid molecule of the invention may neither contain a ribozyme, preferably a self-splicing ribozyme, nor a histone stem-loop processing signal, in particular a histone stem-loop processing sequence derived from mouse histone H2A614 gene.

Furthermore, it is preferred that the inventive artificial nucleic acid molecule according to the present invention does not comprise an intron.

The artificial nucleic acid molecule according to the present invention may be RNA, such as mRNA, DNA, such as a DNA vector, or may be a modified RNA or DNA molecule. It may be provided as a double-stranded molecule having a sense strand and an anti-sense strand, for example, as a DNA molecule having a sense strand and an anti-sense strand.

The invention also provides an artificial nucleic acid molecule which is an mRNA molecule comprising a, 5'UTR element, an open reading frame, a histone stem-loop as described herein, an optional 3'UTR element as described herein and an optional poly(A) sequence.

The artificial nucleic acid molecule according to the present invention may further comprise a 5'-cap. The optional 5'-cap is preferably attached to the 5'-side of the 5'UTR element.

The invention provides an artificial nucleic acid molecule which may be a template for an RNA molecule, preferably for an mRNA molecule, which is stabilised and optimized with respect to translation efficiency. In other words, the artificial nucleic acid molecule may be a DNA or RNA which may be used for production of an mRNA. The obtainable mRNA, may, in turn, be translated for production of a desired peptide or protein encoded by the open reading frame. If the artificial nucleic acid molecule is a DNA, it may, for example, be used as a double-stranded storage form for continued and repetitive in vitro or in vivo production of mRNA.

Potential transcription systems are in vitro transcription systems or cellular transcription systems etc. Accordingly, transcription of an artificial nucleic acid molecule according to the invention, e.g. transcription of an artificial nucleic acid molecule comprising a 5'UTR element, an open reading frame, a histone stem-loop, a 3'UTR element, and a polyadenylation-signal, may result in an mRNA molecule comprising a 5'UTR element, an open reading frame, a histone stem-loop, a 3'UTR element and a poly(A) sequence.

For example, the artificial nucleic acid molecule according to the present invention may comprise a nucleic acid sequence corresponding to the DNA sequence

```
                                          (SEQ ID No. 1377)
CATCACATTT AAAAGCATCT CAGCCTACCA TGAGAATAAG

AGAAAGAAAA TGAAGATCAA AAGCTTATTC ATCTGTTTTT

CTTTTTCGTT GGTGTAAAGC CAACACCCTG TCTAAAAAAC

ATAAATTTCT TTAATCATTT TGCCTCTTTT CTCTGTGCTT

CAATTAATAA AAAATGGAAA GAATCTAGAT CTAAAAAAAA

AAAAAAAAAA AAAAAAAAAA AAAAAAAAAA AAAAAAAAAA

AAAAAAAAAA AAAAAA.
```

Transcription of such a sequence may result in an artificial nucleic acid molecule comprising a corresponding RNA sequence.

Such artificial RNA molecule may also be obtainable in vitro by common methods of chemical synthesis without being necessarily transcribed from a DNA progenitor.

In a particularly preferred embodiment, the artificial nucleic acid molecule according to the present invention is an RNA molecule, preferably an mRNA molecule comprising in 5'-to-3'-direction a 5'UTR element as described above, an open reading frame, an optional 3'UTR element as described above, an optional poly(A) sequence, an optional poly(C) sequence, and a histone stem-loop as described herein.

In some embodiments, the artificial nucleic acid molecule comprises further elements such as an IRES-motif. An internal ribosome entry side (IRES) sequence or IRES-motif may separate several open reading frames, for example if the artificial nucleic acid molecule encodes for two or more peptides or proteins. An IRES-sequence may be particularly helpful if the mRNA is a bi- or multicistronic RNA.

Furthermore, the artificial nucleic acid molecule may comprise additional 5'-elements such as a promoter or enhancer sequence. The promoter may drive and or regulate transcription of the artificial nucleic acid molecule according to the present invention, for example of an artificial DNA molecule according to the present invention.

In preferred embodiments, the invention provides artificial nucleic acid molecules, preferably mRNA molecules, comprising in 5'-to-3'-direction at least one of the following structures:

5'-cap-5'UTR element-ORF-3'UTR element-histone stem-loop-poly(A) sequence
5'-cap-5'UTR element-ORF 3'UTR element-poly(A) sequence-histone stem-loop
5'-cap-5'UTR element-ORF-IRES-ORF-3'UTR element-histone stem-loop-poly(A) sequence
5'-cap-5'UTR element-ORF-IRES-ORF-3'UTR element-poly(A) sequence-histone stem-loop
5'-cap-5'UTR element-ORF-3'UTR element-poly(A) sequence-poly(C) sequence-histone stem-loop
5'-cap-5'UTR element-ORF-IRES-ORF-3'UTR element-poly(A) sequence-poly(C) sequence-histone stem-loop
5'-cap-5'UTR element-ORF-IRES-ORF-3'UTR element-histone stem-loop-poly(A) sequence-poly(C) sequence More preferably, the inventive artificial nucleic acid molecule comprises or codes for (a.) a 5'UTR-element; (b.) an open reading frame, preferably encoding a peptide or protein; (c.) at least one histone stem-loop, optionally (d.) a poly(A) sequence and/or polyadenylation signal; (e.) optionally a poly(C) sequence; and (f.) optionally a 3'UTR element, preferably for increasing the expression level of an encoded protein, wherein the encoded protein is preferably no histone protein, no reporter protein and/or no marker or selection protein, as defined above. The elements (c.) to (f.) of the inventive artificial nucleic acid molecule may occur in the inventive artificial nucleic acid molecule in any sequence, i.e. the elements (a.), (b.), (c.), (d.), (e.) and (f.) may, for example, occur in the sequence (a.), (b.), (c.), (d.), (e.) and (f.), or (a.), (b.), (d.), (c.), (e.) and (f.), or (a.), (b.), (c.), (d.), (f.) and (e.), or (a.), (b.), (d.), (c.), (f.) and (e.), or (a.), (b.), (e.), (d.), (c.) and (f.), or (a.), (b.), (e.), (d.), (f.) and (c.), or (a.), (b.), (c.), (f.), (e.) and (d.) etc., wherein further elements as described herein, may also be contained, such as a 5'-CAP structure, stabilization sequences, IRES sequences, etc. Each of the elements (a.) to (f.) of the inventive artificial nucleic acid molecule, particularly b), may occur in di- or multicistronic constructs and/or each of the elements (a.), (c.) and (f.) may also be repeated at least once, preferably twice or more in the inventive artificial nucleic acid molecule. As an example, the inventive artificial nucleic acid molecule may comprise its sequence elements (a.), (b.), (c.) and optionally (d.) in e.g. the following order. In all cases the artificial nucleic acid molecule may additionally comprise one or more optional 3'UTR element(s) and/or a poly(C) sequence as defined herein:

5'UTR-ORF-histone stem-loop-3'; or
5'UTR-ORF-ORF-histone stem-loop-3'; or
5' UTR-ORF-IRES-ORF-histone stem-loop-3'; or
5' UTR-ORF-histone stem-loop-poly(A) sequence-3'; or
5' UTR-ORF-histone stem-loop-polyadenylation signal-3'; or
5' UTR-ORF-ORF-histone stem-loop-polyadenylation signal-3'; or
5' UTR-ORF-histone stem-loop-histone stem-loop-3'; or
5' UTR-ORF-histone stem-loop-histone stem-loop-poly(A) sequence-3'; or
5' UTR-ORF-histone stem-loop-histone stem-loop-polyadenylation signal-3'; or
5' UTR-ORF-histone stem-loop-poly(A) sequence histone stem-loop-3'; or
5' UTR-ORF-poly(A) sequence-histone stem-loop-3'; or
5' UTR-ORF-poly(A) sequence-histone stem-loop-histone stem-loop-3'; etc.

It is preferred that the above sequences comprise a poly(C) sequence. Preferably, this poly(C) sequence is located 5' to the histone stem-loop, preferably between the poly(A) sequence and the histone stem-loop sequence.

In this context, it is particularly preferred that the inventive artificial nucleic acid molecule comprises or codes for a) a 5'UTR element, b) an open reading frame, preferably encoding a peptide or protein; c) at least one histone stem-loop, and d) a poly(A) sequence or polyadenylation sequence; preferably for increasing the expression level of an encoded protein, wherein the encoded protein is preferably no histone protein, no reporter protein (e.g. Luciferase, GFP, EGFP, β-Galactosidase, particularly EGFP) and/or no marker or selection protein (e.g. alpha-Globin, Galactokinase and Xanthine:Guanine phosphoribosyl transferase (GPT)).

The open reading frame of the artificial nucleic acid molecule is not particularly limited. For example, the open reading frame may encode a protein or peptide that may be used for therapy of a disease. The particular choice of the protein or peptide depends on the disease to be treated and is not the subject of the invention. Accordingly, the artificial nucleic acid molecule may be for use in treatment of a disease that is treatable with the protein or peptide that is encoded by the open reading frame. The open reading frame may also encode a protein or peptide that may be used as an antigen for vaccination. Again, the particular choice of the protein or peptide depends on the disease or infection to be prevented. Accordingly, the artificial nucleic acid molecule may be for use in prevention of a disease by inducing a specific immune response.

However, the encoded protein is preferably no histone protein. In the context of the present invention, such a histone protein is typically a strongly alkaline protein found in eukaryotic cell nuclei, which package and order the DNA into structural units called nucleosomes. Histone proteins are the chief protein components of chromatin, act as spools around which DNA winds, and play a role in gene regulation. Without histones, the unwound DNA in chromosomes would be very long (a length to width ratio of more than 10 million to one in human DNA). For example, each human cell has about 1.8 meters of DNA, but wound on the histones it has about 90 millimeters of chromatin, which, when duplicated and condensed during mitosis, result in about 120 micrometers of chromosomes. More preferably, in the context of the present invention, such a histone protein is typically defined as a highly conserved protein selected from one of the following five major classes of histones: H1/H5, H2A, H2B, H3, and H4", preferably selected from mammalian histone, more preferably from human histones or histone proteins. Such histones or histone proteins are typically organised into two super-classes defined as core histones, comprising histones H2A, H2B, H3 and H4, and linker histones, comprising histones H1 and H5.

In this context, linker histones, are preferably excluded from the scope of protection of the pending invention, preferably mammalian linker histones, more preferably human linker histones, are typically selected from H1, including H1F, particularly including H1F0, H1FNT, H1FOO, H1FX, and H1H1, particularly including HIST1H1A, HIST1H1B, HIST1H1C, HIST1H1D, HIST1H1E, HIST1H1T.

Furthermore, in some embodiments, core histones which are preferably excluded from the scope of protection of the pending invention, preferably mammalian core histones, more preferably human core histones, are typically selected from H2A, including H2AF, particularly including H2AFB1, H2AFB2, H2AFB3, H2AFJ, H2AFV, H2AFX, H2AFY, H2AFY2, H2AFZ, and H2A1, particularly including HIST1H2AA, HIST1H2AB, HIST1H2AC, HIST1H2AD, HIST1H2AE, HIST1H2AG, HIST1H2AI, HIST1H2AJ, HIST1H2AK, HIST1H2AL, HIST1H2AM, and H2A2, particularly including HIST2H2AA3, HIST2H2AC; H2B, including H2BF, particularly including H2BFM, H2BFO, H2BFS, H2BFWT H2B1, particularly including HIST1H2BA, HIST1H2BB, HIST1H2BC, HIST1H2BD, HIST1H2BE, HIST1H2BF, HIST1H2BG, HIST1H2BH, HIST1H2BI, HIST1H2BJ, HIST1H2BK, HIST1H2BL, HIST1H2BM, HIST1H2BN, HIST1H2BO, and H2B2, particularly including HIST2H2BE; H3, including H3A1, particularly including HIST1H3A, HIST1H3B, HIST1H3C, HIST1H3D, HIST1H3E, HIST1H3F, HIST1H3G, HIST1H3H, HIST1H3I, HIST1H3J, and H3A2, particularly including HIST2H3C, and H3A3, particularly including HIST3H3; H4, including H41, particularly including HIST1H4A, HIST1H4B, HIST1H4C, HIST1H4D, HIST1H4E, HIST1H4F, HIST1H4G, HIST1H4H, HIST1H4I, HIST1H4J, HIST1H4K, HIST1H4L, and H44, particularly including HIST4H4, and H5.

Preferably, the protein encoded by the open reading frame is no reporter protein (e.g. Luciferase, Green Fluorescent Protein (GFP), Enhanced Green Fluorescent Protein (EGFP), β-Galactosidase) and no marker or selection protein (e.g. alpha-globin, Galactokinase and Xanthine:guanine phosphoribosyl transferase (GPT)). Preferably, the artificial nucleic acid molecule of the invention does not contain a (bacterial) Neo gene sequence (Neomycin resistance gene).

Preferably, the ORF does not code for a protein selected from the group consisting of albumin proteins, α-globin proteins, β-globin proteins, tyrosine hydroxylase proteins, lipoxygenase proteins, and collagen alpha proteins.

In a preferred embodiment, the open reading frame does not code for human albumin, provided that the 3'UTR element is identical to the 3'UTR of human albumin. In some further embodiment, it is preferred that the open reading frame does not code for human albumin according to GenBank Accession number NM_000477.5 provided that the 3'UTR element is identical to the 3'UTR of human albumin. In some further embodiments, it is preferred that the open reading frame does not code for human albumin or variants thereof provided that the 3'UTR element is a sequence which is identical to SEQ ID No. 1369 or to a corresponding RNA sequence.

Furthermore, in some embodiments, it is preferred that the open reading frame does not code for a reporter protein selected from the group consisting of globin proteins, luciferase proteins, GFP proteins or variants thereof, for example, variants exhibiting at least 70% sequence identity to a globin protein, a luciferase protein, or a GFP protein.

Preferably, the artificial nucleic acid molecule, preferably the open reading frame, is at least partially G/C modified. Thus, the inventive artificial nucleic acid molecule may be thermodynamically stabilized by modifying the G (guanosine)/C (cytidine) content of the molecule. The G/C content of the open reading frame of an artificial nucleic acid molecule according to the present invention may be increased compared to the G/C content of the open reading frame of a corresponding wild type sequence, preferably by using the degeneration of the genetic code. Thus, the encoded amino acid sequence of the nucleic acid molecule is preferably not modified by the G/C modification compared to the coded amino acid sequence of the particular wild type sequence. The codons of a coding sequence or a whole nucleic acid molecule, e.g. an mRNA, may therefore be varied compared to the wild type coding sequence, such that they include an increased amount of G/C nucleotides while the translated amino acid sequence is maintained. In respect to the fact that several codons code for one and the same amino acid (so-called degeneration of the genetic code), the most favourable codons for the stability can be determined (so-called alternative codon usage).

Depending on the amino acid to be encoded by the coding region of the inventive nucleic acid molecule as defined herein, there are various possibilities for modification of the nucleic acid sequence, e.g. the open reading frame, compared to its wild type coding region. In the case of amino acids which are encoded by codons which contain exclusively G or C nucleotides, no modification of the codon is necessary. Thus, the codons for Pro (CCC or CCG), Arg (CGC or CGG), Ala (GCC or GCG) and Gly (GGC or GGG) require no modification, since no A or U/T is present.

In contrast, codons which contain A and/or U/T nucleotides may be modified by substitution of other codons which code for the same amino acids but contain no A and/or U/T. For example
the codons for Pro can be modified from CC(U/T) or CCA to CCC or CCG;
the codons for Arg can be modified from CG(U/T) or CGA or AGA or AGG to CGC or CGG;
the codons for Ala can be modified from GC(U/T) or GCA to GCC or GCG;
the codons for Gly can be modified from GG(U/T) or GGA to GGC or GGG.

In other cases, although A or (U/T) nucleotides cannot be eliminated from the codons, it is however possible to decrease the A and (U/T) content by using codons which contain a lower content of A and/or (U/T) nucleotides. Examples of these are:
The codons for Phe can be modified from (U/T)(U/T)(U/T) to (U/T) (U/T)C;
the codons for Leu can be modified from (U/T) (U/T)A, (U/T) (U/T)G, C(U/T) (U/T) or C(U/T)A to C(U/T)C or C(U/T)G;
the codons for Ser can be modified from (U/T)C(U/T) or (U/T)CA or AG(U/T) to (U/T)CC, (U/T)CG or AGC;
the codon for Tyr can be modified from (U/T)A(U/T) to (U/T)AC;
the codon for Cys can be modified from (U/T)G(U/T) to (U/T)GC;
the codon for His can be modified from CA(U/T) to CAC;
the codon for Gln can be modified from CAA to CAG;
the codons for Ile can be modified from A(U/T)(U/T) or A(U/T)A to A(U/T)C;
the codons for Thr can be modified from AC(U/T) or ACA to ACC or ACG;
the codon for Asn can be modified from AA(U/T) to AAC;
the codon for Lys can be modified from AAA to AAG;
the codons for Val can be modified from G(U/T)(U/T) or G(U/T)A to G(U/T)C or G(U/T)G;
the codon for Asp can be modified from GA(U/T) to GAC;

the codon for Glu can be modified from GAA to GAG; the stop codon (U/T)AA can be modified to (U/T)AG or (U/T)GA.

In the case of the codons for Met (A(U/T)G) and Trp ((U/T)GG), on the other hand, there is no possibility of sequence modification without altering the encoded amino acid sequence.

The substitutions listed above can be used either individually or in all possible combinations to increase the G/C content of the open reading frame of the inventive nucleic acid sequence as defined herein, compared to its particular wild type open reading frame (i.e. the original sequence). Thus, for example, all codons for Thr occurring in the wild type sequence can be modified to ACC (or ACG).

Preferably, the G/C content of the open reading frame of the inventive artificial nucleic acid molecule as defined herein is increased by at least 7%, more preferably by at least 15%, particularly preferably by at least 20%, compared to the G/C content of the wild type coding region. According to a specific embodiment at least 5%, 10%, 20%, 30%, 40%, 50%, 60%, more preferably at least 70%, even more preferably at least 80% and most preferably at least 90%, 95% or even 100% of the substitutable codons in the open reading frame of the inventive artificial nucleic acid molecule or a fragment, variant or derivative thereof are substituted, thereby increasing the G/C content of said open reading frame.

In this context, it is particularly preferable to increase the G/C content of the open reading frame of the inventive nucleic acid sequence as defined herein, to the maximum (i.e. 100% of the substitutable codons), compared to the wild type open reading frame.

Furthermore, the open reading frame is preferably at least partially codon-optimized. Codon-optimization is based on the finding that the translation efficiency may be determined by a different frequency in the occurrence of transfer RNAs (tRNAs) in cells. Thus, if so-called "rare codons" are present in the coding region of the inventive artificial nucleic acid molecule as defined herein, to an increased extent, the translation of the corresponding modified nucleic acid sequence is less efficient than in the case where codons coding for relatively "frequent" tRNAs are present.

Thus, the open reading frame of the inventive nucleic acid sequence is preferably modified compared to the corresponding wild type coding region such that at least one codon of the wild type sequence which codes for a tRNA which is relatively rare in the cell is exchanged for a codon which codes for a tRNA which is comparably frequent in the cell and carries the same amino acid as the relatively rare tRNA. By this modification, the open reading frame of the inventive artificial nucleic acid molecule as defined herein, is modified such that codons for which frequently occurring tRNAs are available may replace codons which correspond to rare tRNAs. In other words, according to the invention, by such a modification all codons of the wild type open reading frame which code for a rare tRNA may be exchanged for a codon which codes for a tRNA which is more frequent in the cell and which carries the same amino acid as the rare tRNA. Which tRNAs occur relatively frequently in the cell and which, in contrast, occur relatively rarely is known to a person skilled in the art; cf. e.g. Akashi, Curr. Opin. Genet. Dev. 2001, 11(6): 660-666. Accordingly, preferably, the open reading frame is codon-optimized, preferably with respect to the system in which the nucleic acid molecule according to the present invention is to be expressed, preferably with respect to the system in which the nucleic acid molecule according to the present invention is to be translated. Preferably, the codon usage of the open reading frame is codon-optimized according to mammalian codon usage, more preferably according to human codon usage. Preferably, the open reading frame is codon-optimized and G/C-content modified.

For further improving degradation resistance, e.g. resistance to in vivo degradation by an exo- or endonuclease, and/or for further improving protein production from the artificial nucleic acid molecule according to the present invention, the artificial nucleic acid molecule may further comprise modifications, such as backbone modifications, sugar modifications and/or base modifications, e.g., lipid-modifications or the like. Preferably, the transcription and/or the translation of the artificial nucleic acid molecule according to the present invention is not significantly impaired by said modifications.

Nucleotide analogues/modifications that may be used in the context of the present invention may be selected, for example, from 2-amino-6-chloropurineriboside-5'-triphosphate, 2-aminoadenosine-5'-triphosphate, 2-thiocytidine-5'-triphosphate, 2-thiouridine-5'-triphosphate, 4-thiouridine-5'-triphosphate, 5-aminoallylcytidine-5'-triphosphate, 5-aminoallyluridine-5 '-triphosphate, 5-bromocytidine-5'-triphosphate, 5-bromouridine-5'-triphosphate, 5-iodocytidine-5'-triphosphate, 5-iodouridine-5'-triphosphate, 5-methylcytidine-5'-triphosphate, 5-methyluridine-5'-triphosphate, 6-azacytidine-5'-triphosphate, 6-azauridine-5'-triphosphate, 6-chloropurineriboside-5'-triphosphate, 7-deazaadenosine-5'-triphosphate, 7-deazaguanosine-5'-triphosphate, 8-azaadenosine-5'-triphosphate, 8-azidoadenosine-5'-triphosphate, benzimidazole-riboside-5'-triphosphate, N1-methyladenosine-5'-triphosphate, N1-methylguanosine-5'-triphosphate, N6-methyladenosine-5'-triphosphate, O6-methylguanosine-5'-triphosphate, pseudouridine-5'-triphosphate, or puromycin-5'-triphosphate, xanthosine-5'-triphosphate. Particular preference is given to nucleotides for base modifications selected from the group of base-modified nucleotides consisting of 5-methylcytidine-5'-triphosphate, 7-deazaguanosine-5'-triphosphate, 5-bromocytidine-5'-triphosphate, and pseudouridine-5'-triphosphate.

Further, lipid-modified artificial nucleic acid molecules may typically comprise at least one linker which is covalently linked with the artificial nucleic acid molecule, and at least one lipid which is covalently linked with this linker. Alternatively, a lipid-modified artificial nucleic acid molecule may comprise at least one artificial nucleic acid molecule as defined herein and at least one, preferably bifunctional lipid which is covalently linked, preferably without a linker, with that artificial nucleic acid molecule. According to a third alternative, a lipid-modified artificial nucleic acid molecule may comprise an artificial nucleic acid molecule as defined herein, at least one linker which is covalently linked with that artificial nucleic acid molecule, at least one lipid which is covalently linked with this linker, and additionally at least one, preferably bifunctional lipid which is covalently linked, preferably without a linker, with the artificial nucleic acid molecule.

In a further aspect, the present invention provides a vector comprising (a.) at least one 5'-untranslated region element (5'UTR element) which comprises or consists of a nucleic acid sequence which is derived from the 5'UTR of a TOP gene or which is derived from a variant of the 5'UTR of a TOP gene;

(b.) at least one open reading frame and/or at least one cloning site; and (c.) optionally, at least one histone stem-loop.

The cloning site may be suitable for accepting an open reading frame, i.e. an open reading frame coding for a protein or peptide to be expressed may be cloned into the vector via the cloning site.

The at least one 5'UTR element, the at least one ORF, and the at least one optional histone stem-loop are as described herein for the artificial nucleic acid molecule according to the present invention. The cloning site may be any sequence that is suitable for introducing an open reading frame or a sequence comprising an open reading frame, such as one or more restriction sites.

Thus, the vector comprising a cloning site is preferably suitable for inserting an open reading frame into the vector. Preferably, it may be suitable for inserting an open reading frame between the 5'UTR element and a desired 3' structure such as a histone stem loop, a polyl(A) sequence, a polyadenylation signal and/or a 3'UTR element, more preferably it is suitable for insertion 5' to the 3' structure and 3' to the 5'UTR element. For example the 3' structure may comprise a histone stem-loop, a poly(A) sequence or a polyadenylation signal and/or a 3'UTR element as described above. Thereby the histone stem loop, the poly(A) sequence and/or the polyadenylation signal and the 3'UTR element may occur in any order that may be desired. Preferably, the cloning site or the ORF is located 5' to the 3'UTR structure, preferably in close proximity to the 5'-end of the histone stem-loop, poly(A) sequence, polyadenylation signal and/or a 3'UTR element as described above. For example, the cloning site or the ORF may be directly connected to the 5'-end of the histone stem-loop, poly(A) sequence, polyadenylation signal and/or a 3'UTR element or they may be connected via a stretch of nucleotides, such as by a stretch of 2, 4, 6, 8, 10, 20 etc. nucleotides as described above for the artificial nucleic acid molecule according to the present invention. Preferably, the cloning site or the ORF is located 3' to the 5'UTR element, preferably in close proximity to the 3'-end of the 5'UTR element. For example, the cloning site or the ORF may be directly connected to the 3'-end of the 5'UTR element or they may be connected via a stretch of nucleotides, such as by a stretch of 2, 4, 6, 8, 10, 20 etc. nucleotides as described above for the artificial nucleic acid molecule according to the present invention.

Preferably, the vector according to the present invention is suitable for producing the artificial nucleic acid molecule according to the present invention, preferably for producing an artificial mRNA according to the present invention, for example, by optionally inserting an open reading frame or a sequence comprising an open reading frame into the vector and transcribing the vector. Thus, preferably, the vector comprises elements needed for transcription, such as a promoter, e.g. an RNA polymerase promoter. Preferably, the vector is suitable for transcription using eukaryotic, prokaryotic, viral or phage transcription systems, such as eukaryotic cells, prokaryotic cells, or eukaryotic, prokaryotic, viral or phage in vitro transcription systems. Thus, for example, the vector may comprise a promoter sequence, which is recognizes by a polymerase, such as by an RNA polymerase, e.g. by a eukaryotic, prokaryotic, viral, or phage RNA polymerase. In a preferred embodiment, the vector comprises a phage RNA polymerase promoter such as an SP6 or T7, preferably a T7 promoter. Preferably, the vector is suitable for in vitro transcription using a phage based in vitro transcription system, such as a T7 RNA polymerase based in vitro transcription system. The vector may further comprise a poly(A) sequence and/or a polyadenylation signal and/or a poly(C) sequence as described above for the artificial nucleic acid molecule according to the present invention.

The vector may be an RNA vector or a DNA vector. Preferably, the vector is a DNA vector. The vector may be any vector known to the skilled person, such as a viral vector or a plasmid vector. Preferably, the vector is a plasmid vector, preferably a DNA plasmid vector.

In a preferred embodiment, the vector according to the present invention comprises or codes for the artificial nucleic acid molecule according to the present invention.

Preferably, a vector according to the present invention comprises a sequence according to SEQ ID NOs. 1-1363, SEQ ID NO. 1435, SEQ ID NO. 1461, SEQ ID NO. 1462, or a sequence according to SEQ ID NOs. 1368 or 1452-1460, a fragment thereof as described above, or a corresponding RNA sequence, or a sequence having an identity of at least about 40%, preferably of at least about 50%, preferably of at least about 60%, preferably of at least about 70%, more preferably of at least about 80%, more preferably of at least about 90%, even more preferably of at least about 95%; even more preferably of at least about 99% to a sequence according to any one of SEQ ID NOs. 1-1363, SEQ ID NO. 1435, SEQ ID NO. 1461, SEQ ID NO. 1462, or a sequence according to SEQ ID NOs. 1368 or 1452-1460, a fragment thereof as described above, preferably a functional fragment thereof, or a corresponding RNA sequence.

Preferably, a vector according to the present invention comprises a sequence according to any one of SEQ ID Nos. 1369-1390 and 1434, a fragment thereof as described above or a corresponding RNA sequence, or a sequence having an identity of at least about 40%, preferably of at least about 50%, preferably of at least about 60%, preferably of at least about 70%, more preferably of at least about 80%, more preferably of at least about 90%, even more preferably of at least about 95%; even more preferably of at least about 99% to a sequence according to any one of SEQ ID Nos. 1369-1390 and 1434 or a fragment thereof as described above, preferably a functional fragment thereof, or a corresponding RNA sequence.

Preferably, a vector according to the present invention comprises a sequence according to any one of SEQ ID Nos. 1391-1433 or a corresponding RNA sequence, or a sequence having an identity of at least about 75%, preferably of at least about 80%, more preferably of at least about 85%, even more preferably of at least about 90%; even more preferably of at least about 95% to a sequence according to SEQ ID Nos. 1433 as described above or a corresponding RNA sequence.

Preferably, the vector is a circular molecule. Preferably, the vector is a double-stranded molecule, such as a double stranded DNA molecule. Such circular, preferably double stranded DNA molecule may be used conveniently as a storage form for the inventive artificial nucleic acid molecule. Furthermore, it may be used for transfection of cells, for example, cultured cells. Also it may be used for in vitro transcription for obtaining an artificial RNA molecule according to the invention.

Preferably, the vector, preferably the circular vector, is linearizable, for example, by restriction enzyme digestion. In a preferred embodiment, the vector comprises a cleavage site, such as a restriction site, preferably a unique cleavage site, located immediately 3' to the open reading frame or—if present—to the histone stem-loop, or—if present—to the poly(A) sequence or the polyadenylation signal, or—if present—to the 3'UTR element, or—if present—to the poly (C) sequence. Thus, preferably, the product obtained by linearizing the vector terminates at the 3'end with the 3'-end of the open reading frame, or—if present—with the 3'-end of the histone stem loop, or—if present—with the 3'-end of the poly(A) sequence or the 3'-end of the polyadenylation signal, or—if present—with the 3'-end of a 3'UTR element, plus some optional nucleotides, e.g. remaining from the restriction site after cleavage.

In a further aspect, the present invention relates to a cell comprising the artificial nucleic acid molecule according to the present invention or the vector according to the present invention. The cell may be any cell, such as a bacterial cell, insect cell, plant cell, vertebrate cell, e.g. a mammalian cell. Such cell may be, e.g., used for replication of the vector of the present invention, for example, in a bacterial cell. Furthermore, the cell may be used for transcribing the artificial nucleic acid molecule or the vector according to the present invention and/or translating the open reading frame of the artificial nucleic acid molecule or the vector according to the present invention. For example, the cell may be used for recombinant protein production.

The cells according to the present invention are, for example, obtainable by standard nucleic acid transfer methods, such as standard transfection methods. For example, the artificial nucleic acid molecule or the vector according to the present invention may be transferred into the cell by electroporation, lipofection, e.g. based on cationic lipids and/or liposomes, calcium phosphate precipitation, nanoparticle based transfection, virus based transfection, or based on cationic polymers, such as DEAE-dextran or polyethylenimine etc.

Preferably, the cell is a mammalian cell, such as a cell of a human subject, a domestic animal, a laboratory animal, such as a mouse or rat cell. Preferably the cell is a human cell. The cell may be a cell of an established cell line, such as a CHO, BHK, 293T, COS-7, HELA, HEK etc. cell, or the cell may be a primary cell, such as a HDF cell, preferably a cell isolated from an organism. In a preferred embodiment, the cell is an isolated cell of a mammalian subject, preferably of a human subject. For example, the cell may be an immune cell, such as a dendritic cell, a cancer or tumor cell, or any somatic cell etc., preferably of a mammalian subject, preferably of a human subject.

In a further aspect, the present invention provides a pharmaceutical composition comprising the artificial nucleic acid molecule according to the present invention, the vector according the present invention, or the cell according to the present invention. The pharmaceutical composition according to the invention may be used, e.g., as a vaccine, for example, for genetic vaccination. Thus, the ORF may, e.g., encode an antigen to be administered to a patient for vaccination. Thus, in a preferred embodiment, the pharmaceutical composition according to the present invention is a vaccine. Furthermore, the pharmaceutical composition according to the present invention may be used, e.g., for gene therapy.

Preferably, the pharmaceutical composition further comprises one or more pharmaceutically acceptable excipients, vehicles, fillers and/or diluents. In the context of the present invention, a pharmaceutically acceptable vehicle typically includes a liquid or non-liquid basis for the inventive pharmaceutical composition. In one embodiment, the pharmaceutical composition is provided in liquid form. In this context, preferably, the vehicle is based on water, such as pyrogen-free water, isotonic saline or buffered (aqueous) solutions, e.g. phosphate, citrate etc. buffered solutions. The buffer may be hypertonic, isotonic or hypotonic with reference to the specific reference medium, i.e. the buffer may have a higher, identical or lower salt content with reference to the specific reference medium, wherein preferably such concentrations of the afore mentioned salts may be used, which do not lead to damage of mammalian cells due to osmosis or other concentration effects. Reference media are e.g. liquids occurring in "in vivo" methods, such as blood, lymph, cytosolic liquids, or other body liquids, or e.g. liquids, which may be used as reference media in "in vitro" methods, such as common buffers or liquids. Such common buffers or liquids are known to a skilled person. Ringer-Lactate solution is particularly preferred as a liquid basis.

One or more compatible solid or liquid fillers or diluents or encapsulating compounds suitable for administration to a patient may be used as well for the inventive pharmaceutical composition. The term "compatible" as used herein preferably means that these components of the inventive pharmaceutical composition are capable of being mixed with the inventive nucleic acid, vector or cells as defined herein in such a manner that no interaction occurs which would substantially reduce the pharmaceutical effectiveness of the inventive pharmaceutical composition under typical use conditions.

The pharmaceutical composition according to the present invention may optionally further comprise one or more additional pharmaceutically active components. A pharmaceutically active component in this context is a compound that exhibits a therapeutic effect to heal, ameliorate or prevent a particular indication or disease. Such compounds include, without implying any limitation, peptides or proteins, nucleic acids, (therapeutically active) low molecular weight organic or inorganic compounds (molecular weight less than 5000, preferably less than 1000), sugars, antigens or antibodies, therapeutic agents already known in the prior art, antigenic cells, antigenic cellular fragments, cellular fractions, cell wall components (e.g. polysaccharides), modified, attenuated or de-activated (e.g. chemically or by irradiation) pathogens (virus, bacteria etc.).

Furthermore, the inventive pharmaceutical composition may comprise a carrier for the artificial nucleic acid molecule or the vector. Such a carrier may be suitable for mediating dissolution in physiological acceptable liquids, transport and cellular uptake of the pharmaceutical active artificial nucleic acid molecule or the vector. Accordingly, such a carrier may be a component which may be suitable for depot and delivery of an artificial nucleic acid molecule or vector according to the invention. Such components may be, for example, cationic or polycationic carriers or compounds which may serve as transfection or complexation agent.

Particularly preferred transfection or complexation agents in this context are cationic or polycationic compounds, including protamine, nucleoline, spermine or spermidine, or other cationic peptides or proteins, such as poly-L-lysine (PLL), poly-arginine, basic polypeptides, cell penetrating peptides (CPPs), including HIV-binding peptides, HIV-1 Tat (HIV), Tat-derived peptides, Penetratin, VP22 derived or analog peptides, HSV VP22 (Herpes simplex), MAP, KALA or protein transduction domains (PTDs), PpT620, prolin-rich peptides, arginine-rich peptides, lysine-rich peptides, MPG-peptide(s), Pep-1, L-oligomers, Calcitonin peptide(s), *Antennapedia*-derived peptides (particularly from *Drosophila antennapedia*), pAntp, plsl, FGF, Lactoferrin, Transportan, Buforin-2, Bac715-24, SynB, SynB(1), pVEC, hCT-derived peptides, SAP, or histones.

Furthermore, such cationic or polycationic compounds or carriers may be cationic or polycationic peptides or proteins, which preferably comprise or are additionally modified to comprise at least one —SH moiety. Preferably, a cationic or polycationic carrier is selected from cationic peptides having the following sum formula (III):

$\{(Arg)_l;(Lys)_m;(His)_n;(Orn)_o;(Xaa)_x\};$    formula (III)

wherein l+m+n+o+x=3-100, and l, m, n or o independently of each other is any number selected from 0, 1, 2, 3, 4, 5, 6, 7, 8, 9, 10, 11, 12, 13, 14, 15, 16, 17, 18, 19, 20, 21-30, 31-40, 41-50, 51-60, 61-70, 71-80, 81-90 and 91-100 provided that the overall content of Arg (Arginine), Lys (Lysine), His (Histidine) and Orn (Ornithine) represents at least 10% of all amino acids of the oligopeptide; and Xaa is any amino acid selected from native (=naturally occurring) or non-native amino acids except of Arg, Lys, His or Orn; and x is any number selected from 0, 1, 2, 3, 4, 5, 6, 7, 8, 9, 10, 11, 12, 13, 14, 15, 16, 17, 18, 19, 20, 21-30, 31-40, 41-50, 51-60, 61-70, 71-80, 81-90, provided, that the overall content of Xaa does not exceed 90% of all amino acids of the oligopeptide. Any of amino acids Arg, Lys, His, Orn and Xaa may be positioned at any place of the peptide. In this context cationic peptides or proteins in the range of 7-30 amino acids are particular preferred.

Further, the cationic or polycationic peptide or protein, when defined according to formula $\{(Arg)_l;(Lys)_m;(His)_n;(Orn)_o;(Xaa)_x\}$ (formula (III)) as shown above and which comprise or are additionally modified to comprise at least one —SH moiety, may be, without being restricted thereto, selected from subformula (IIIa):

$\{(Arg)_l;(Lys)_m;(His)_n;(Orn)_o;(Xaa')_x(Cys)_y\}$    subformula (IIIa)

wherein $(Arg)_l;(Lys)_m;(His)_n;(Orn)_o;$ and x are as defined herein, Xaa' is any amino acid selected from native (=naturally occurring) or non-native amino acids except of Arg, Lys, His, Orn or Cys and y is any number selected from 0, 1, 2, 3, 4, 5, 6, 7, 8, 9, 10, 11, 12, 13, 14, 15, 16, 17, 18, 19, 20, 21-30, 31-40, 41-50, 51-60, 61-70, 71-80 and 81-90, provided that the overall content of Arg (Arginine), Lys (Lysine), His (Histidine) and Orn (Ornithine) represents at least 10% of all amino acids of the oligopeptide. Further, the cationic or polycationic peptide may be selected from subformula (IIIb):

$Cys_1\{(Arg)_l;(Lys)_m;(His)_n;(Orn)_o;(Xaa)_x\}Cys_2$    subformula (IIIb)

wherein empirical formula $\{(Arg)_l;(Lys)_m;(His)_n;(Orn)_o;(Xaa)_x\}$ (formula (III)) is as defined herein and forms a core of an amino acid sequence according to (semiempirical) formula (III) and wherein $Cys_1$ and $Cys_2$ are Cysteines proximal to, or terminal to $(Arg)_l;(Lys)_m;(His)_n;(Orn)_o;(Xaa)_x$.

Further preferred cationic or polycationic compounds, which can be used as transfection or complexation agent may include cationic polysaccharides, for example chitosan, polybrene, cationic polymers, e.g. polyethyleneimine (PEI), cationic lipids, e.g. DOTMA: [1-(2,3-sioleyloxy)propyl)]-N,N,N-trimethylammonium chloride, DMRIE, di-C14-amidine, DOTIM, SAINT, DC-Chol, BGTC, CTAP, DOPC, DODAP, DOPE: Dioleyl phosphatidylethanol-amine, DOSPA, DODAB, DOIC, DMEPC, DOGS: Dioctadecylamidoglicylspermin, DIMRI: Dimyristo-oxypropyl dimethyl hydroxyethyl ammonium bromide, DOTAP: dioleoyloxy-3-(trimethylammonio)propane, DC-6-14: O,O-ditetradecanoyl-N-(α-trimethylammonioacetyl) diethanolamine chloride, CLIP1: rac-[(2,3-dioctadecyloxypropyl)(2-hydroxyethyl)]-dimethylammonium chloride, CLIP6: rac-[2(2,3-dihexadecyloxypropyl-oxymethyloxy)ethyl] trimethylammonium, CLIP9: rac-[2(2,3-dihexadecyloxypropyl-oxysuccinyloxy)ethyl]-trimethylammonium, oligofectamine, or cationic or polycationic polymers, e.g. modified polyaminoacids, such as β-amino acid-polymers or reversed polyamides, etc., modified polyethylenes, such as PVP (poly(N-ethyl-4-vinylpyridinium bromide)), etc., modified acrylates, such as pDMAEMA (poly(dimethylaminoethyl methylacrylate)), etc., modified Amidoamines such as pAMAM (poly(amidoamine)), etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI: poly(ethyleneimine), poly(propyleneimine), etc., polyallylamine, sugar backbone based polymers, such as cyclodextrin based polymers, dextran based polymers, chitosan, etc., silan backbone based polymers, such as PMOXA-PDMS copolymers, etc., blockpolymers consisting of a combination of one or more cationic blocks (e.g. selected from a cationic polymer as mentioned above) and of one or more hydrophilic or hydrophobic blocks (e.g. polyethyleneglycole); etc.

In this context, it is particularly preferred that the inventive artificial nucleic acid molecule or the inventive vector is complexed at least partially with a cationic or polycationic compound, preferably cationic proteins or peptides. Partially means that only a part of the inventive artificial nucleic acid molecule or the inventive vector is complexed with a cationic or polycationic compound and that the rest of the inventive artificial nucleic acid molecule or the inventive vector is in uncomplexed form ("free"). Preferably the ratio of complexed nucleic acid to:free nucleic acid is selected from a range. of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), and most preferably the ratio of complexed nucleic acid to free nucleic acid is selected from a ratio of about 1:1 (w/w).

The pharmaceutical composition according to the present invention may optionally further comprise one or more adjuvants, for example, adjuvants for stimulating the innate immune system or for enhancing cellular uptake of the artificial nucleic acid molecule or vector. In this context, an adjuvant may be understood as any compound, which is suitable to initiate or increase an immune response of the innate immune system, i.e. a non-specific immune response. In other words, when administered, the inventive pharmaceutical composition preferably elicits an innate immune response due to the adjuvant, optionally contained therein. Preferably, such an adjuvant may be an adjuvant supporting the induction of an innate immune response in a mammal. Such an adjuvant may be, for example, an immunostimulatory nucleic acid, i.e. a nucleic acid that may bind to a Toll-like-receptor or the like, preferably an immunostimulatory RNA.

Such adjuvants, preferably such immunostimulatory nucleic acids, may induce an innate, i.e. unspecific, immune response which may support a specific, i.e. adaptive, immune response to the peptide or protein, i.e. the antigen, encoded by the artificial nucleic acid molecule of the pharmaceutical composition, preferably the vaccine.

The inventive pharmaceutical composition may also additionally comprise any further compound, which is known to be immunostimulating due to its binding affinity (as ligands) to human Toll-like receptors TLR1, TLR2, TLR3, TLR4, TLR5, TLR6, TLR7, TLR8, TLR9, TLR10, or due to its binding affinity (as ligands) to murine Toll-like receptors TLR1, TLR2, TLR3, TLR4, TLR5, TLR6, TLR7, TLR8, TLR9, TLR10, TLR11, TLR12 or TLR13.

Further additives which may be included in the inventive pharmaceutical composition are, e.g., emulsifiers, such as, for example, Tween®; wetting agents, such as, for example, sodium lauryl sulfate; colouring agents; taste-imparting agents, pharmaceutical carriers; tablet-forming agents; stabilizers; antioxidants; preservatives etc.

The pharmaceutical composition according to the present invention preferably comprises a "safe and effective amount" of the components of the pharmaceutical composition, particularly of the inventive nucleic acid sequence, the vector and/or the cells as defined herein. As used herein, a "safe and effective amount" means an amount sufficient to significantly induce a positive modification of a disease or disorder as defined herein. At the same time, however, a "safe and effective amount" preferably avoids serious side-effects and permits a sensible relationship between advantage and risk. The determination of these limits typically lies within the scope of sensible medical judgment.

In a further aspect, the present invention provides the artificial nucleic acid molecule according to the present invention, the vector according to the present invention, the cell according to the present invention, or the pharmaceutical composition according to the present invention for use as a medicament, for example, as vaccine (in genetic vaccination) or in gene therapy.

The artificial nucleic acid molecule according to the present invention, the vector according to the present invention, the cell according to the present invention, or the pharmaceutical composition according to the present invention are particularly suitable for any medical application which makes use of the therapeutic action or effect of peptides, polypeptides or proteins, or where supplementation of a particular peptide or protein is needed. Thus, the present invention provides the artificial nucleic acid molecule according to the present invention, the vector according to the present invention, the cell according to the present invention, or the pharmaceutical composition according to the present invention for use in the treatment or prevention of diseases or disorders amenable to treatment by the therapeutic action or effect of peptides, polypeptides or proteins or amenable to treatment by supplementation of a particular peptide, polypeptide or protein. For example, the artificial nucleic acid molecule according to the present invention, the vector according to the present invention, the cell according to the present invention, or the pharmaceutical composition according to the present invention may be used for the treatment or prevention of genetic diseases, autoimmune diseases, cancerous or tumour-related diseases, infectious diseases, chronic diseases or the like, e.g., by genetic vaccination or gene therapy.

In particular, such therapeutic treatments which benefit from a stable, prolonged and/or increased presence of therapeutic peptides, polypeptides or proteins in a subject to be treated are especially suitable as medical application in the context of the present invention, since the 5'UTR element in particular in combination with a histone stem-loop provides for increased protein expression from the ORF of the inventive nucleic acid molecule. Thus, a particularly suitable medical application for the artificial nucleic acid molecule according to the present invention, the vector according to the present invention, the cell according to the present invention, or the pharmaceutical composition according to the present invention is vaccination, for example against infections or tumours. Thus, the present invention provides the artificial nucleic acid molecule according to the present invention, the vector according to the present invention, the cell according to the present invention, or the pharmaceutical composition according to the present invention for vaccination of a subject, preferably a mammalian subject, more preferably a human subject. Preferred vaccination treatments are vaccination against infectious diseases, such as bacterial, protozoal or viral infections, and anti-tumour-vaccination. Such vaccination treatments may be prophylactic or therapeutic.

Depending on the disease to be treated or prevented, the ORF may be selected. For example, the open reading frame may code for a protein that has to be supplied to a patient suffering from total lack or at least partial loss of function of a protein, such as a patient suffering from a genetic disease. Additionally, the open reading frame may be chosen from an ORF coding for a peptide or protein which beneficially influences a disease or the condition of a subject. Furthermore, the open reading frame may code for a peptide or protein which effects down-regulation of a pathological overproduction of a natural peptide or protein or elimination of cells expressing pathologically a protein or peptide. Such lack, loss of function or overproduction may, e.g., occur in the context of tumour and neoplasia, autoimmune diseases, allergies, infections, chronic diseases or the like. Furthermore, the open reading frame may code for an antigen or immunogen, e.g. for an epitope of a pathogen or for a tumour antigen. Thus, in preferred embodiments, the artificial nucleic acid molecule or the vector according to the present invention comprises an ORF encoding an amino acid sequence comprising or consisting of an antigen or immunogen, e.g. an epitope of a pathogen or a tumour-associated antigen, a 5'UTR element as described above, preferably a histone stem-loop as described herein, and optional further components, such as a 3'UTR element and/or a poly(A) sequence and/or a poly(C) sequence etc. as described herein.

In the context of medical application, in particular, in the context of vaccination, it is preferred that the artificial nucleic acid molecule according to the present invention is RNA, preferably mRNA, since DNA harbours the risk of eliciting an anti-DNA immune response and tends to insert into genomic DNA. However, in some embodiments, for example, if a viral delivery vehicle, such as an adenoviral delivery vehicle is used for delivery of the artificial nucleic acid molecule or the vector according to the present invention, e.g., in the context of gene therapeutic treatments, it may be desirable that the artificial nucleic acid molecule or the vector is a DNA molecule.

The artificial nucleic acid molecule according to the present invention, the vector according to the present invention, the cell according to the present invention, or the pharmaceutical composition according to the present invention may be administered orally, parenterally, by inhalation spray, topically, rectally, nasally, buccally, vaginally or via an implanted reservoir. The term parenteral as used herein includes subcutaneous, intravenous, intramuscular, intra-articular, intra-synovial, intrasternal, intrathecal, intrahepatic, intralesional, intracranial, transdermal, intradermal, intrapulmonal, intraperitoneal, intracardial, intraarterial, and sublingual injection or infusion techniques.

Preferably, the artificial nucleic acid molecule according to the present invention, the vector according to the present invention, the cell according to the present invention, or the pharmaceutical composition according to the present invention is administered parenterally, e.g. by parenteral injection, more preferably by subcutaneous, intravenous, intramuscular, intra-articular, intra-synovial, intrasternal, intrathecal, intrahepatic, intralesional, intracranial, transdermal, intradermal, intrapulmonal, intraperitoneal, intracardial, intraarterial, sublingual injection or via infusion techniques. Particularly preferred is intradermal and intramuscular injection. Sterile injectable forms of the inventive pharmaceutical composition may be aqueous or oleaginous suspension. These suspensions may be formulated according to techniques known in the art using suitable dispersing or wetting agents and suspending agents.

The artificial nucleic acid molecule according to the present invention, the vector according to the present invention, the cell according to the present invention, or the pharmaceutical composition according to the present invention may also be administered orally in any orally acceptable dosage form including, but not limited to, capsules, tablets, aqueous suspensions or solutions.

The artificial nucleic acid molecule according to the present invention, the vector according to the present invention, the cell according to the present invention, or the pharmaceutical composition according to the present invention may also be administered topically, especially when the target of treatment includes areas or organs readily accessible by topical application, e.g. including diseases of the skin or of any other accessible epithelial tissue. Suitable topical formulations are readily prepared for each of these areas or organs. For topical applications, the artificial nucleic acid molecule according to the present invention, the vector according to the present invention, the cell according to the present invention, or the pharmaceutical composition according to the present invention may be formulated in a suitable ointment suspended or dissolved in one or more carriers.

In one embodiment, the use as a medicament comprises the step of transfection of mammalian cells, preferably in vitro transfection of mammalian cells, more preferably in vitro transfection of isolated cells of a subject to be treated by the medicament. If the use comprises the in vitro transfection of isolated cells, the use as a medicament may further comprise the (re)administration of the transfected cells to the patient. The use of the inventive artificial nucleic acid molecules or the vector as a medicament may further comprise the step of selection of successfully transfected isolated cells. Thus, it may be beneficial if the vector further comprises a selection marker. Also, the use as a medicament may comprise in vitro transfection of isolated cells and purification of an expression-product, i.e. the encoded peptide or protein from these cells. This purified peptide or protein may subsequently be administered to a subject in need thereof.

The present invention also provides a method for treating or preventing a disease or disorder as described above comprising administering the artificial nucleic acid molecule according to the present invention, the vector according to the present invention, the cell according to the present invention, or the pharmaceutical composition according to the present invention to a subject in need thereof.

Furthermore, the present invention provides a method for treating or preventing a disease or disorder comprising transfection of a cell with an artificial nucleic acid molecule according to the present invention or with the vector according to the present invention. Said transfection may be performed in vitro or in vivo. In a preferred embodiment, transfection of a cell is performed in vitro and the transfected cell is administered to a subject in need thereof, preferably to a human patient. Preferably, the cell which is to be transfected in vitro is an isolated cell of the subject, preferably of the human patient. Thus, the present invention provides a method of treatment comprising the steps of isolating a cell from a subject, preferably from a human patient, transfecting the isolated cell with the artificial nucleic acid molecule according to the present invention or the vector according to the present invention, and administering the transfected cell to the subject, preferably the human patient.

The method of treating or preventing a disorder according to the present invention is preferably a vaccination method and/or a gene therapy method as described above.

As described above, the 5'UTR element, preferably, the histone stem-loop, and optionally the poly(A)sequence and/or the 3'UTR element are capable of increasing protein production from an artificial nucleic acid molecule, such as an mRNA or vector, comprising these elements and an ORF, preferably in an at least additive, preferably in a synergistic manner. Thus, in a further aspect, the present invention relates to a method for increasing protein production from an artificial nucleic acid molecule comprising the step of associating the artificial nucleic acid molecule, preferably an ORF contained within the artificial nucleic acid molecule, with (i) at least one 5'-untranslated region element (5'UTR element) which comprises or consists of a nucleic acid sequence which is derived from the 5'UTR of a TOP gene or which is derived from a variant of the 5'UTR of a TOP gene as described above, preferably (ii) at least one histone stem-loop as described herein, and optionally one or more further elements, such as a poly(A)sequence and/or polyadenylation signal, and/or a poly(C) sequence, and/or a 3'UTR element, which comprises or consists of a nucleic acid sequence derived from the 3'UTR of a chordate gene, preferably a vertebrate gene, more preferably a mammalian gene, most preferably a human gene, or from a variant of the 3'UTR of a chordate gene, preferably a vertebrate gene, more preferably a mammalian gene, most preferably a human gene as described above.

Associating the artificial nucleic acid molecule or the vector with a 5'UTR element and preferably a histone stem-loop as well as optional further elements in the context of the present invention preferably means functionally associating or functionally combining an artificial nucleic acid molecule, e.g. comprising an ORF, such as an mRNA or a vector, with the 5'UTR element and optionally the histone stem-loop and/or the poly(A) sequence and/or the 3'UTR element. This means that the artificial nucleic acid molecule, preferably the ORF contained within the artificial nucleic acid molecule, the 5'UTR element and preferably the histone stem-loop and the optional further elements, such as the poly(A)sequence and/or the 3'UTR element as described above, are associated or coupled such that the function of the 5'UTR element and the histone stem-loop and the optional further elements, e.g. protein production increasing function, is exerted. Typically, this means that the 5'UTR element and the histone stem-loop and optionally the poly(A)sequence and/or the 3'UTR element are integrated into the artificial nucleic acid molecule, preferably into the mRNA molecule or the vector, such that the open reading frame is positioned between the 5'UTR element and the optional histone stem-loop and the optional poly(A)sequence and/or the optional 3'UTR element.

The product of said method is preferably the artificial nucleic acid molecule according to the present invention or the vector according to the present invention. Thus, e.g. the nature and sequence of the elements, such as the 5'UTR element, the histone stem-loop, the poly(A) sequence, the polyadenylation signal, the poly(C) sequence, and the 3'UTR element are as described above for the artificial nucleic acid molecule according to the present invention or the vector according to the present invention.

In a further aspect, the present invention provides the use of at least one 5'-untranslated region element (5'UTR element) which comprises or consists of a nucleic acid sequence which is derived from the 5'UTR of a TOP gene or which is derived from a variant of the 5'UTR of a TOP gene as described above, preferably at least one histone stem-loop, and optionally further elements, such as a poly(A) sequence and/or a polyadenylation signal, and/or a poly(C) signal), and/or a 3'UTR element which comprises or consists of a nucleic acid sequence derived from the 3'UTR of a chordate gene, preferably a vertebrate gene, more preferably a mammalian gene, most preferably a human gene, or from a variant of the 3'UTR of a chordate gene, preferably a vertebrate gene, more preferably a mammalian gene, most preferably a human gene as described above for increasing protein production from an artificial nucleic acid molecule, such as an mRNA or a vector.

The use according to the present invention preferably comprises associating the artificial nucleic acid molecule with the 5'UTR element, preferably the histone stem-loop and optional further elements, such as a poly(A)sequence or 3'UTR element etc., as described above.

The compounds and ingredients of the inventive pharmaceutical composition may also be manufactured and traded separately of each other. Thus, the invention relates further to a kit or kit of parts comprising an artificial nucleic acid molecule according to the invention, a vector according to the present invention, a cell according to the invention, and/or a pharmaceutical composition according to the invention. Preferably, such kit or kit of parts may, additionally, comprise instructions for use, cells for transfection, an adjuvant, a means for administration of the pharmaceutical composition, a pharmaceutically acceptable carrier and/or an pharmaceutically acceptable solution for dissolution or dilution of the artificial nucleic acid molecule, the vector, the cells or the pharmaceutical composition.

The following Figures, Sequences and Examples are intended to illustrate the invention further. They are not intended to limit the subject-matter of the invention thereto.

FIG. 1: shows the histone stem-loop consensus sequence generated from metazoan and protozoan stem-loop sequences (as reported by Dávila López, M., & Samuelsson, T. (2008), *RNA* (New York, N.Y.), 14(1), 1-10. doi:10.1261/rna.782308). 4001 histone stem-loop sequences from metazoa and protozoa were aligned and the quantity of the occurring nucleotides is indicated for every position in the stem-loop sequence. The generated consensus sequence representing all nucleotides present in the sequences analyzed is given using the single-letter nucleotide code. In addition to the consensus sequence, sequences are shown representing at least 99%, 95% and 90% of the nucleotides present in the sequences analyzed.

FIG. 2: shows the histone stem-loop consensus sequence generated from protozoan stem-loop sequences (as reported by Dávila López, M., & Samuelsson, T. (2008), *RNA* (New York, N.Y.), 14(1), 1-10. doi:10.1261/rna.782308). 131 histone stem-loop sequences from protozoa were aligned and the quantity of the occurring nucleotides is indicated for every position in the stem-loop sequence. The generated consensus sequence representing all nucleotides present in the sequences analyzed is given using the single-letter nucleotide code. In addition to the consensus sequence, sequences are shown representing at least 99%, 95% and 90% of the nucleotides present in the sequences analyzed.

FIG. 3: shows the histone stem-loop consensus sequence generated from metazoan stem-loop sequences (as reported by Dávila López, M., & Samuelsson, T. (2008), *RNA* (New York, N.Y.), 14(1), 1-10. doi:10.1261/rna.782308). 3870 histone stem-loop sequences from metazoa were aligned and the quantity of the occurring nucleotides is indicated for every position in the stem-loop sequence. The generated consensus sequence representing all nucleotides present in the sequences analyzed is given using the single-letter nucleotide code. In addition to the consensus sequence, sequences are shown representing at least 99%, 95% and 90% of the nucleotides present in the sequences analyzed.

FIG. 4: shows the histone stem-loop consensus sequence generated from vertebrate stem-loop sequences (as reported by Dávila López, M., & Samuelsson, T. (2008), *RNA* (New York, N.Y.), 14(1), 1-10. doi:10.1261/rna.782308). 1333 histone stem-loop sequences from vertebrates were aligned and the quantity of the occurring nucleotides is indicated for every position in the stem-loop sequence. The generated consensus sequence representing all nucleotides present in the sequences analyzed is given using the single-letter nucleotide code. In addition to the consensus sequence, sequences are shown representing at least 99%, 95% and 90% of the nucleotides present in the sequences analyzed.

FIG. 5: shows the histone stem-loop consensus sequence generated from human (*Homo sapiens*) stem-loop sequences (as reported by Dávila López, M., & Samuelsson, T. (2008), *RNA* (New York, N.Y.), 14(1), 1-10. doi:10.1261/rna.782308). 84 histone stem-loop sequences from humans were aligned and the quantity of the occurring nucleotides is indicated for every position in the stem-loop sequence. The generated consensus sequence representing all nucleotides present in the sequences analyzed is given using the single-letter nucleotide code. In addition to the consensus sequence, sequences are shown representing at least 99%, 95% and 90% of the nucleotides present in the sequences analyzed.

FIG. 6 shows the nucleotide sequence of a *Photinus pyralis* luciferase encoding nucleic acid molecule PpLuc (GC)-ag-A64. This artificial construct does not comprise a 5'UTR element or a histone stem loop. The coding region for PpLuc(GC) is depicted in italics. The sequence depicted in FIG. 6 corresponds to SEQ ID No. 1364.

FIG. 7 shows the nucleotide sequence of RPL32 PpLuc (GC)-ag-A64-C30-histoneSL. The 5'UTR of human ribosomal protein Large 32 lacking the 5' terminal oligopyrimidine tract was inserted 5' of the ORF. A histoneSL was appended 3' of A64 poly(A). The coding region for PpLuc (GC) is depicted in italics. The 5'UTR element sequence and the histone stem-loop sequence are underlined. The sequence depicted in FIG. 7 corresponds to SEQ ID No. 1365.

FIG. 8 shows that the combination of the 5'UTR element derived from the 5'UTR of the TOP gene RPL32 and a histone stem-loop increases protein production from mRNA strongly. The effect of the combination of the 5'UTR element and the histone stem-loop on luciferase expression from mRNA was examined. To this end, different mRNAs were transfected into human dermal fibroblasts (HDF) by lipofection. Luciferase levels were measured at 24 hours after transfection. Luciferase was clearly expressed from mRNA having neither 5'UTR element nor histoneSL. Strikingly however, the combination of 5'UTR element and histoneSL strongly increased the luciferase level. The magnitude of the rise in luciferase level due to combining 5'UTR element and histoneSL in the same mRNA indicates that they are acting synergistically. Data are graphed as mean RLU±SD (relative light units±standard deviation) for duplicate transfections. RLU are summarized in Example 5.1.

FIG. 9 shows the nucleotide sequence of PpLuc(GC)ag-A64-histoneSL. A histoneSL was appended 3' of A64 poly (A). The coding region for PpLuc(GC) is depicted in italics. The histone stem-loop sequence is underlined. The sequence depicted in FIG. 9 corresponds to SEQ ID No. 1464.

FIG. 10 shows the nucleotide sequence of rpl32-PpLuc (GC)-ag-A64. The 5'UTR of human ribosomal protein Large 32 lacking the 5' terminal oligopyrimidine tract was inserted 5' of the ORF. The coding region for PpLuc(GC) is depicted in italics. The 5'UTR element sequence is underlined. The sequence depicted in FIG. 10 corresponds to SEQ ID No. 1463.

FIG. 11 shows the nucleotide sequence of rpl32-PpLuc (GC)-ag-A64-histoneSL. The 5'UTR of human ribosomal protein Large 32 lacking the 5' terminal oligopyrimidine tract was inserted 5' of the ORF. A histoneSL was appended 3' of A64 poly(A). The coding region for PpLuc(GC) is depicted in italics. The 5'UTR element sequence and the histone stem-loop sequence are underlined. The sequence depicted in FIG. 11 corresponds to SEQ ID No. 1480.

Figure 12:
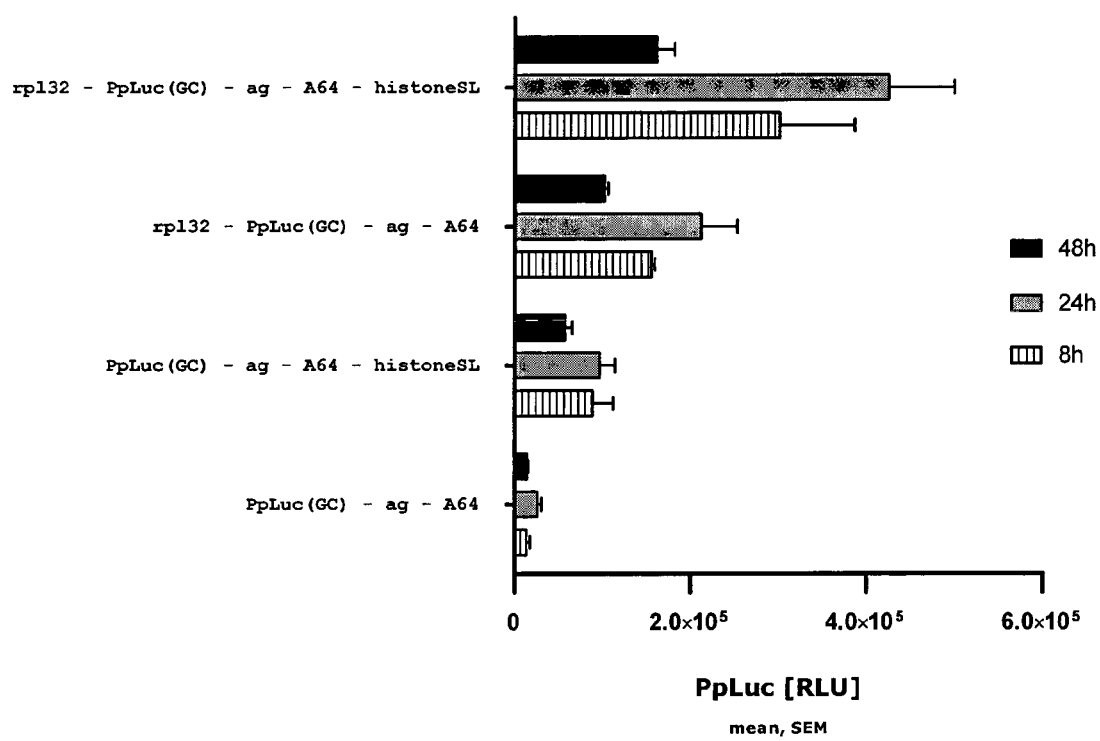

FIG. 12 is a graphical representation of the effect of the 5'UTR element derived from the 5'UTR of the TOP gene RPL32, the histone stem-loop, and the combination of the 5'UTR element and the histone stem-loop on luciferase expression from mRNA. A variety of mRNAs were transfected into human dermal fibroblasts (HDF) by lipofection. Luciferase levels were measured at 8, 24, and 48 hours after transfection. Both, either the histone stem-loop or the 5'UTR element increase luciferase levels compared to mRNA lacking both these elements. Strikingly, the combination of 5'UTR element and histone stem-loop further strongly increases the luciferase level, much above the level observed with either of the individual elements, thus acting synergistically. Data are graphed as mean RLU±SEM (relative light units±standard error) for triplicate transfections. RLU are summarized in Example 5.2.

FIG. 13 shows the nucleotide sequence of rpl32-PpLuc (GC)-albumin7-A64-C30-histoneSL. The albumin7 3'UTR element replaced the alpha-globin 3'UTR element in the construct shown in FIG. 7 (which contains the rpl32 5'UTR element). The 5'UTR element sequence is underlined. The sequence depicted in FIG. 13 corresponds to SEQ ID No. 1481.

FIG. 14 shows the nucleotide sequence of rpl35-PpLuc (GC)-albumin7-A64-C30-histoneSL. The 5'UTR of human ribosomal protein Large 35 lacking the 5' terminal oligopyrimidine tract replaced the rpl32 5'UTR element in the construct shown in FIG. 13. The 5'UTR element sequence is underlined. The sequence depicted in FIG. 14 corresponds to SEQ ID No. 1436.

FIG. 15 shows the nucleotide sequence of rpl21-PpLuc (GC)-albumin7-A64-C30-histoneSL. The 5'UTR of human ribosomal protein Large 21 lacking the 5' terminal oligopyrimidine tract replaced the rpl32 5'UTR element in the construct shown in FIG. 13. The 5'UTR element sequence is underlined. The sequence depicted in FIG. 15 corresponds to SEQ ID No. 1437.

FIG. 16 shows the nucleotide sequence of atp5a1-PpLuc (GC)-albumin7-A64-C30-histoneSL. The 5'UTR of human ATP synthase, H+ transporting, mitochondrial F1 complex, alpha subunit 1 lacking the 5' terminal oligopyrimidine tract replaced the rpl32 5'UTR element in the construct shown in FIG. 13. The 5'UTR element sequence is underlined. The sequence depicted in FIG. 16 corresponds to SEQ ID No. 1438.

FIG. 17 shows the nucleotide sequence of HSD17B4-PpLuc(GC)-albumin7-A64-C30-histoneSL. The 5'UTR of human hydroxysteroid (17-beta) dehydrogenase 4 lacking the 5' terminal oligopyrimidine tract replaced the rpl32 5'UTR element in the construct shown in FIG. 13. The 5'UTR element sequence is underlined. The sequence depicted in FIG. 17 corresponds to SEQ ID No. 1439.

FIG. 18 shows the nucleotide sequence of AIG1-PpLuc (GC)-albumin7-A64-C30-histoneSL. The 5'UTR of human androgen-induced 1 lacking the 5' terminal oligopyrimidine tract replaced the rpl32 element sequence is underlined. The sequence depicted in FIG. 18 corresponds to SEQ ID No. 1440.

FIG. 19 shows the nucleotide sequence of COX6C-PpLuc (GC)-albumin7-A64-C30-histoneSL. The 5'UTR of human cytochrome c oxidase subunit VIc lacking the 5' terminal oligopyrimidine tract replaced the rpl32 5'UTR element in the construct shown in FIG. 13. The 5'UTR element sequence is underlined. The sequence depicted in FIG. 19 corresponds to SEQ ID No. 1441.

FIG. 20 shows the nucleotide sequence of ASAH1-PpLuc (GC)-albumin7-A64-C30-histoneSL. The 5'UTR of human N-acylsphingosine amidohydrolase (acid ceramidase) 1 lacking the 5' terminal oligopyrimidine tract replaced the rpl32 5'UTR element in the construct shown in FIG. 13. The 5'UTR element sequence is underlined. The sequence depicted in FIG. 20 corresponds to SEQ ID No. 1442.

Figure 21:
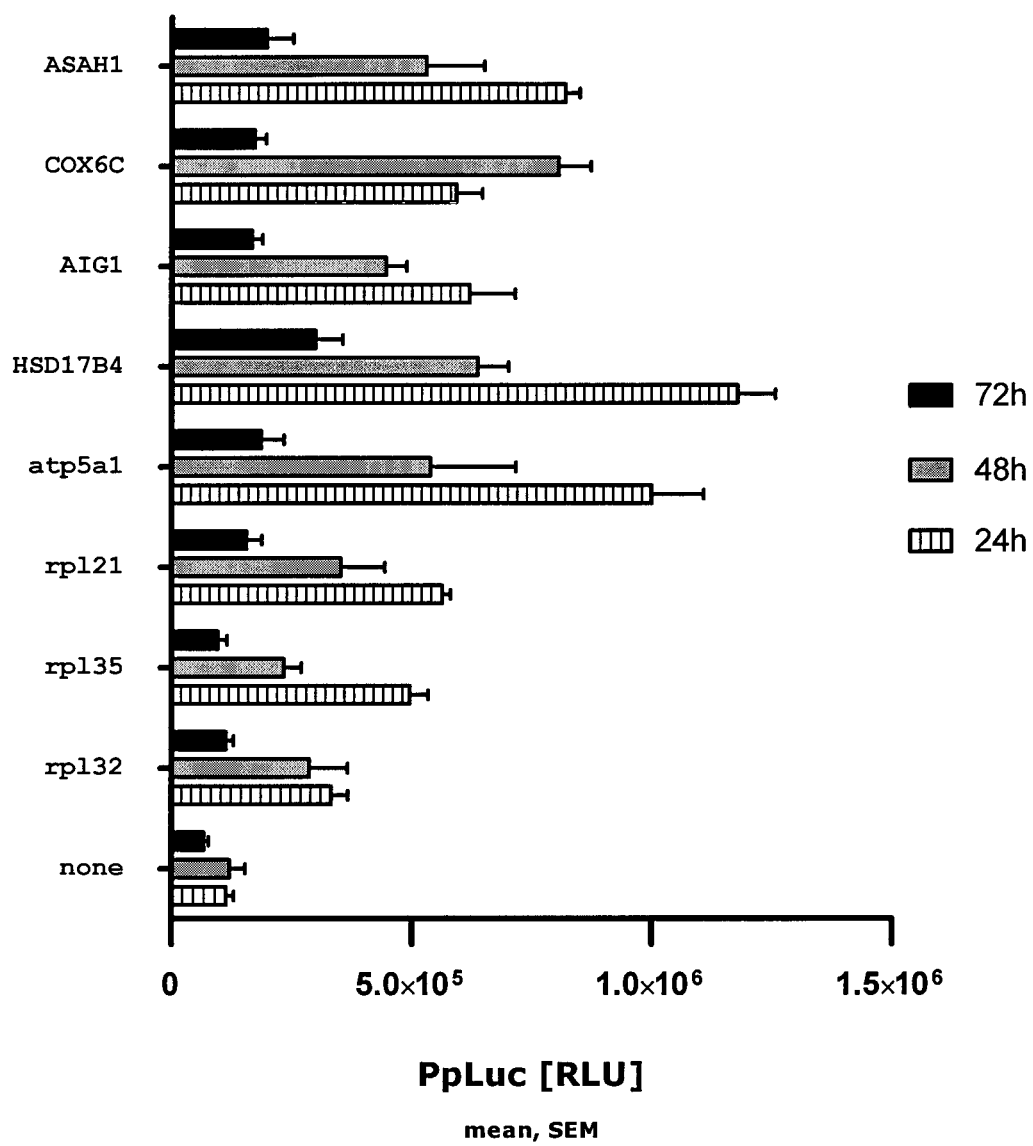

FIG. 21 is a graphical representation of the effect of the 5'UTR element derived from the TOP genes RPL32, RPL35, RPL21, ATP5A1, HSD17B4, AIG1, COX6C and ASAH1 on luciferase expression from mRNA. The mRNAs were transfected into human dermal fibroblasts (HDF) by lipofection. Luciferase levels were measured at 24, 48, and 72 hours after transfection. The 5'UTR elements strongly increase luciferase levels compared to mRNA lacking a 5'UTR element. Data are graphed as mean RLU±SEM (relative light units±standard error) for triplicate transfections. RLU are summarized in Example 5.3.

FIG. 22 shows the nucleotide sequence of rpl35-PpLuc (GC)-ag-A64. The 5'UTR of human ribosomal protein Large 35 lacking the 5' terminal oligopyrimidine tract replaced the rpl32 5'UTR element in the construct shown in FIG. 10. The coding region for PpLuc(GC) is depicted in italics. The 5'UTR element sequence is underlined. The sequence depicted in FIG. 22 corresponds to SEQ ID No. 1466.

FIG. 23 shows the nucleotide sequence of rpl21-PpLuc (GC)-ag-A64. The 5'UTR of human ribosomal protein Large 21 lacking the 5' terminal oligopyrimidine tract replaced the rpl32 5'UTR element in the construct shown in FIG. 10. The coding region for PpLuc(GC) is depicted in italics. The 5'UTR element sequence is underlined. The sequence depicted in FIG. 23 corresponds to SEQ ID No. 1467.

FIG. 24 shows the nucleotide sequence of atp5a1-PpLuc (GC)-ag-A64. The 5'UTR of human ATP synthase, H+ transporting, mitochondrial F1 complex, alpha subunit 1 lacking the 5' terminal oligopyrimidine tract replaced the rpl32 5'UTR element in the construct shown in FIG. 10. The coding region for PpLuc(GC) is depicted in italics. The 5'UTR element sequence is underlined. The sequence depicted in FIG. 24 corresponds to SEQ ID No. 1468.

FIG. 25 shows the nucleotide sequence of HSD17B4-PpLuc(GC)-ag-A64. The 5'UTR of human hydroxysteroid (17-beta) dehydrogenase 4 lacking the 5' terminal oligopyrimidine tract replaced the rpl32 5'UTR element in the construct shown in FIG. 10. The coding region for PpLuc (GC) is depicted in italics. The 5'UTR element sequence is underlined. The sequence depicted in FIG. 25 corresponds to SEQ ID No. 1469.

FIG. 26 shows the nucleotide sequence of AIG1-PpLuc (GC)-ag-A64. The 5'UTR of human androgen-induced 1 lacking the 5' terminal oligopyrimidine tract replaced the rpl32 5'UTR element in the construct shown in FIG. 10. The coding region for PpLuc(GC) is depicted in italics. The 5'UTR element sequence is underlined. The sequence depicted in FIG. 26 corresponds to SEQ ID No. 1470.

FIG. 27 shows the nucleotide sequence of COX6C-PpLuc (GC)-ag-A64. The 5'UTR of human cytochrome c oxidase subunit VIc lacking the 5' terminal oligopyrimidine tract replaced the rpl32 5'UTR element in the construct shown in FIG. 10. The coding region for PpLuc(GC) is depicted in italics. The 5'UTR element sequence is underlined. The sequence depicted in FIG. 27 corresponds to SEQ ID No. 1471.

FIG. 28 shows the nucleotide sequence of ASAH1-PpLuc (GC)-ag-A64. The 5'UTR of human N-acylsphingosine amidohydrolase (acid ceramidase) 1 lacking the 5' terminal oligopyrimidine tract replaced the rpl32 5'UTR element in the construct shown in FIG. 10. The coding region for PpLuc(GC) is depicted in italics. The 5'UTR element sequence is underlined. The sequence depicted in FIG. 28 corresponds to SEQ ID No. 1472.

FIG. 29 shows the nucleotide sequence of rpl35-PpLuc (GC)-ag-A64-histoneSL. The 5'UTR of human ribosomal protein Large 35 lacking the 5' terminal oligopyrimidine tract replaced the rpl32 5'UTR element in the construct shown in FIG. 11. The coding region for PpLuc(GC) is depicted in italics. The 5'UTR element sequence and the histone stem-loop sequence are underlined. The sequence depicted in FIG. 29 corresponds to SEQ ID No. 1473.

FIG. 30 shows the nucleotide sequence of rpl21-PpLuc (GC)-ag-A64-histoneSL. The 5'UTR of human ribosomal protein Large 21 lacking the 5' terminal oligopyrimidine tract replaced the rpl32 5'UTR element in the construct shown in FIG. 11. The coding region for PpLuc(GC) is depicted in italics. The 5'UTR element sequence and the histone stem-loop sequence are underlined. The sequence depicted in FIG. 30 corresponds to SEQ ID No. 1474.

FIG. 31 shows the nucleotide sequence of atp5a1-PpLuc (GC)-ag-A64-histoneSL. The 5'UTR of human ATP synthase, H+ transporting, mitochondrial F1 complex, alpha subunit 1 lacking the 5' terminal oligopyrimidine tract replaced the rpl32 5'UTR element in the construct shown in FIG. 11. The coding region for PpLuc(GC) is depicted in italics. The 5'UTR element sequence and the histone stem-loop sequence are underlined. The sequence depicted in FIG. 31 corresponds to SEQ ID No. 1475.

FIG. 32 shows the nucleotide sequence of HSD17B4-PpLuc(GC)-ag-A64-histoneSL. The 5'UTR of human hydroxysteroid (17-beta) dehydrogenase 4 lacking the 5' terminal oligopyrimidine tract replaced the rpl32 5'UTR element in the construct shown in FIG. 11. The coding region for PpLuc(GC) is depicted in italics. The 5'UTR element sequence and the histone stem-loop sequence are underlined. The sequence depicted in FIG. 32 corresponds to SEQ ID No. 1476.

FIG. 33 shows the nucleotide sequence of AIG1-PpLuc (GC)-ag-A64-histoneSL. The 5'UTR of human androgen-induced 1 lacking the 5' terminal oligopyrimidine tract replaced the rpl32 5'UTR element in the construct shown in FIG. 11. The coding region for PpLuc(GC) is depicted in italics. The 5'UTR element sequence and the histone stem-loop sequence are underlined. The sequence depicted in FIG. 33 corresponds to SEQ ID No. 1477.

FIG. 34 shows the nucleotide sequence of COX6C-PpLuc (GC)-ag-A64-histoneSL. The 5'UTR of human cytochrome c oxidase subunit VIc lacking the 5' terminal oligopyrimidine tract replaced the rpl32 5'UTR element in the construct shown in FIG. 11. The coding region for PpLuc(GC) is depicted in italics. The 5'UTR element sequence and the histone stem-loop sequence are underlined. The sequence depicted in FIG. 34 corresponds to SEQ ID No. 1478.

FIG. 35 shows the nucleotide sequence of ASAH1-PpLuc (GC)-ag-A64-histoneSL. The 5'UTR of human N-acyl-sphingosine amidohydrolase (acid ceramidase) 1 lacking the 5' terminal oligopyrimidine tract replaced the rpl32 5'UTR element in the construct shown in FIG. 11. The coding region for PpLuc(GC) is depicted in italics. The 5'UTR element sequence and the histone stem-loop sequence are underlined. The sequence depicted in FIG. 35 corresponds to SEQ ID No. 1479.

Figure 36:
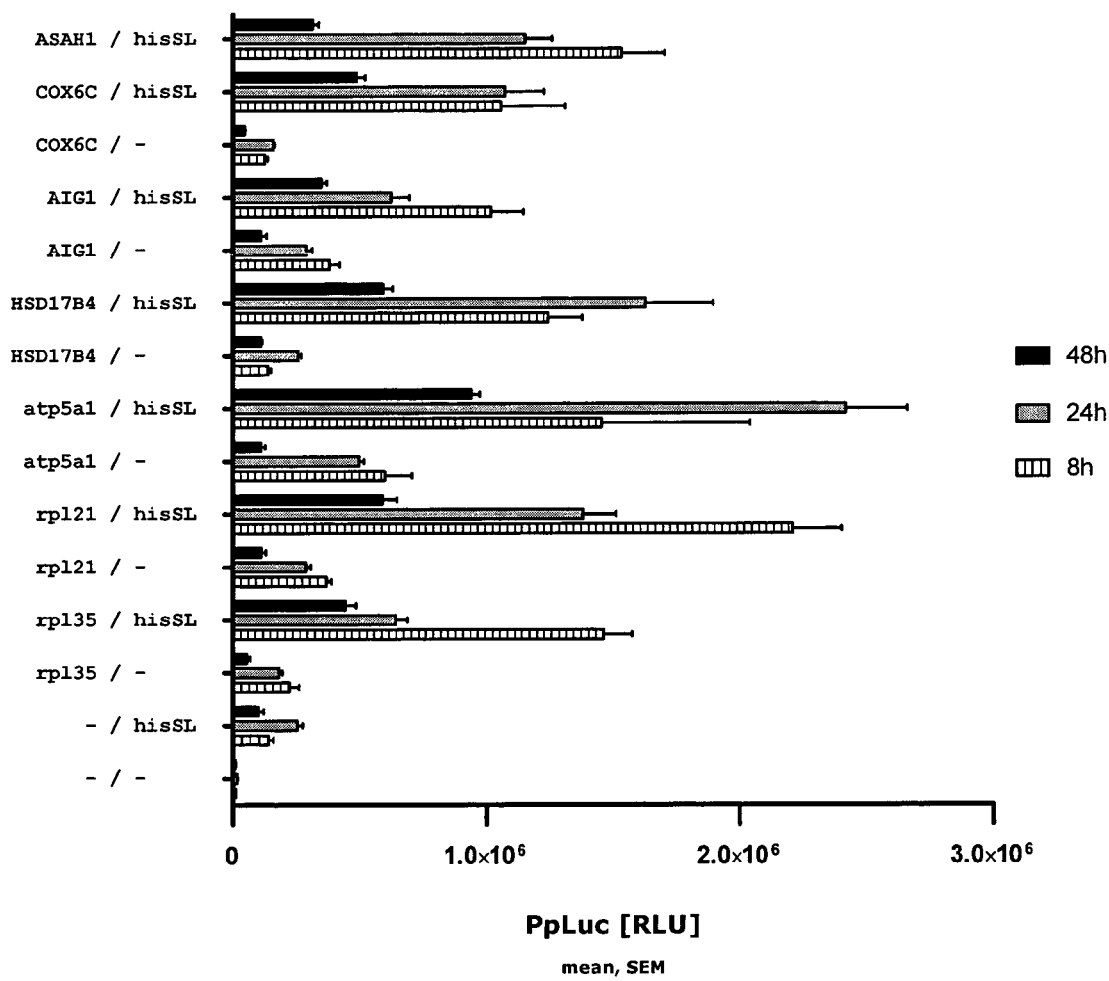

FIG. 36 is a graphical representation of the effect of 5'UTR elements derived from 5'UTRs of the TOP genes RPL35, RPL21, ATP5A1, HSD17B4, AIG1, COX6C and ASAH1, the histone stem-loop, and the combination of 5'UTR elements and histone stem-loop on luciferase expression from mRNA. The different mRNAs were transfected into human dermal fibroblasts (HDF) by lipofection. Luciferase levels were measured at 8, 24, and 48 hours after transfection. Both, either the histone stem-loop or the 5'UTR elements increase luciferase levels compared to mRNA lacking both these elements. Strikingly, the combination of 5'UTR elements and histone stem-loop further strongly increases the luciferase level, much above the level observed with either of the individual elements, thus acting synergistically. Data are graphed as mean RLU±SEM (relative light units±standard error) for triplicate transfections. The synergy between 5'UTR elements and histone stem-loop is summarized in example 5.4.

FIG. 37 shows the nucleotide sequence of mrpl21-PpLuc (GC)-albumin7-A64-C30-histoneSL. The 5'UTR of murine ribosomal protein Large 21 lacking the 5' terminal oligopyrimidine tract replaced the rpl32 5'UTR element in the construct shown in FIG. 13. The 5'UTR element sequence is underlined. The sequence depicted in FIG. 36 corresponds to SEQ ID No. 1443.

FIG. 38 shows the nucleotide sequence of mrpl35A-PpLuc(GC)-albumin7-A64-C30-histoneSL. The 5'UTR of murine ribosomal protein Large 35A lacking the 5' terminal oligopyrimidine tract replaced the rpl32 5'UTR element in the construct shown in FIG. 13. The 5'UTR element sequence is underlined. The sequence depicted in FIG. 37 corresponds to SEQ ID No. 1444.

Figure 39:
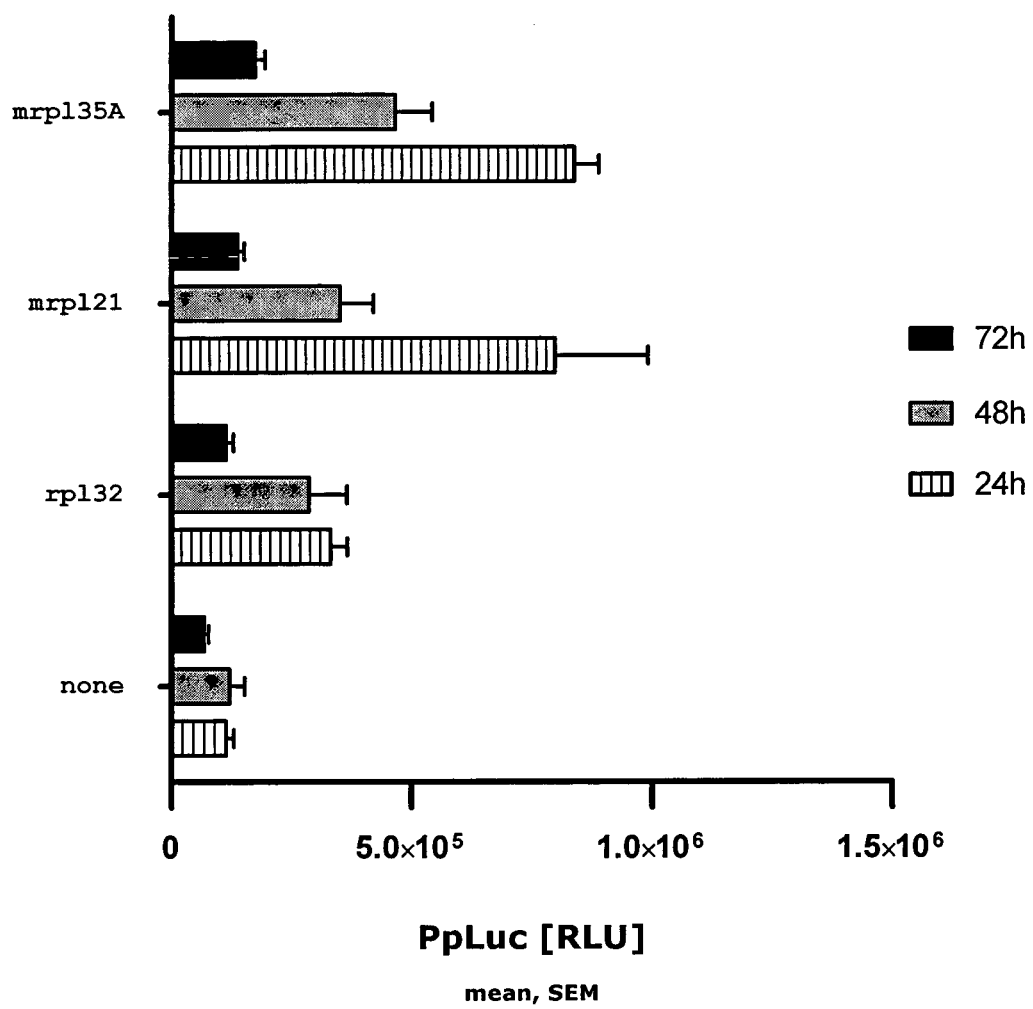

FIG. 39 is a graphical representation of the effect of the 5'UTR elements derived from 5'UTRs of mouse TOP genes on luciferase expression from mRNA. mRNAs containing either a mouse or a human 5'UTR element were transfected into human dermal fibroblasts (HDF) by lipofection. Luciferase levels were measured at 24, 48, and 72 hours after transfection. Mouse 5'UTR elements strongly increase luciferase levels compared to mRNA lacking a 5'UTR element, similarly as the human 5'UTR element. Data are graphed as mean RLU±SEM (relative light units±standard error) for triplicate transfections. RLU are summarized in Example 5.5.

SEQ ID No. 1-1363. 1435, and 1461-1462 sequences comprising 5'UTRs of TOP genes
SEQ ID No. 1364 PpLuc(GC)-ag-A64 (FIG. 6)

SEQ ID No. 1365 RPL32-PpLuc(GC)-ag-A64-C30-histoneSL (FIG. 7)
SEQ ID No. 1366 fragment of the 5'UTR of human ribosomal protein Large 32
SEQ ID No. 1367 fragment of the 5'UTR of human ribosomal protein Large 32
SEQ ID No. 1368 5'UTR of human ribosomal protein Large 32 lacking the 5' terminal oligopyrimidine tract
SEQ ID No. 1369 Human albumin 3'UTR
SEQ ID No. 1370 3'UTR of *Homo sapiens* hemoglobin, alpha 1 (HBA1)
SEQ ID No. 1371 3'UTR of *Homo sapiens* hemoglobin, alpha 2 (HBA2)
SEQ ID No. 1372 3'UTR of *Homo sapiens* hemoglobin, beta (HBB)
SEQ ID No. 1373 3'UTR of *Homo sapiens* tyrosine hydroxylase (TH)
SEQ ID No. 1374 3'UTR of *Homo sapiens* arachidonate 15-lipoxygenase (ALOX15)
SEQ ID No. 1375 3'UTR of *Homo sapiens* collagen, type I, alpha 1 (COL1A1)
SEQ ID No. 1376 albumin7 3'UTR
SEQ ID No. 1377 Human albumin 3'UTR+poly(A) sequence
SEQ ID No. 1378 Human albumin 3'UTR fragment 1
SEQ ID No. 1379 Human albumin 3'UTR fragment 2
SEQ ID No. 1380 Human albumin 3'UTR fragment 3
SEQ ID No. 1381 Human albumin 3'UTR fragment 4
SEQ ID No. 1382 Human albumin 3'UTR fragment 5
SEQ ID No. 1383 Human albumin 3'UTR fragment 6
SEQ ID No. 1384 Human albumin 3'UTR fragment 7
SEQ ID No. 1385 Human albumin 3'UTR fragment 8
SEQ ID No. 1386 Human albumin 3'UTR fragment 9
SEQ ID No. 1387 Human albumin 3'UTR fragment 10
SEQ ID No. 1388 Human albumin 3'UTR fragment 11
SEQ ID No. 1389 Human albumin 3'UTR fragment 12
SEQ ID No. 1390 Human albumin 3'UTR fragment 13
SEQ ID NO. 1391 Sequence according to formula (Ic)
SEQ ID NO. 1392 Sequence according to formula (IIc):
SEQ ID NO. 1393 Sequence according to formula (Id):
SEQ ID NO. 1394 Sequence according to formula (IId)
SEQ ID NO. 1395 Sequence according to formula (Ie)
SEQ ID NO. 1396 Sequence according to formula (IIe)
SEQ ID NO. 1397 Sequence according to formula (If)
SEQ ID NO. 1398 Sequence according to formula (IIf)
SEQ ID NO. 1399 Sequence according to formula (Ig)
SEQ ID NO. 1400 Sequence according to formula (IIg)
SEQ ID NO. 1401 Sequence according to formula (Ih)
SEQ ID NO. 1402 Sequence according to formula (IIh)
SEQ ID NO. 1403 Sequence according to formula (Ic)
SEQ ID NO. 1404 Sequence according to formula (Ic)
SEQ ID NO. 1405 Sequence according to formula (Ic)
SEQ ID NO. 1406 Sequence according to formula (Ie)
SEQ ID NO. 1407 Sequence according to formula (Ie)
SEQ ID NO. 1408 Sequence according to formula (Ie)
SEQ ID NO. 1409 Sequence according to formula (If)
SEQ ID NO. 1410 Sequence according to formula (If)
SEQ ID NO. 1411 Sequence according to formula (If)
SEQ ID NO. 1412 Sequence according to formula (Ig)
SEQ ID NO. 1413 Sequence according to formula (Ig)
SEQ ID NO. 1414 Sequence according to formula (Ig)
SEQ ID NO. 1415 Sequence according to formula (Ih)
SEQ ID NO. 1416 Sequence according to formula (Ih)
SEQ ID NO. 1417 Sequence according to formula (Ih)
SEQ ID NO. 1418 Sequence according to formula (IIc)
SEQ ID NO. 1419 Sequence according to formula (IIc)
SEQ ID NO. 1420 Sequence according to formula (IIc)
SEQ ID NO. 1421 Sequence according to formula (IIe)
SEQ ID NO. 1422 Sequence according to formula (IIe)
SEQ ID NO. 1423 Sequence according to formula (IIe)
SEQ ID NO. 1424 Sequence according to formula (IIf)
SEQ ID NO. 1425 Sequence according to formula (IIf)
SEQ ID NO. 1426 Sequence according to formula (IIf)
SEQ ID NO. 1427 Sequence according to formula (IIg)
SEQ ID NO. 1428 Sequence according to formula (IIg)
SEQ ID NO. 1429 Sequence according to formula (IIg)
SEQ ID NO. 1430 Sequence according to formula (IIh)
SEQ ID NO. 1431 Sequence according to formula (IIh)
SEQ ID NO. 1432 Sequence according to formula (IIh)
SEQ ID NO. 1433 Example histone stem-loop sequence
SEQ ID NO. 1434 Center, α-complex-binding portion of the 3'UTR of an α-globin gene
SEQ ID NO. 1435 ATP synthase lipid-binding protein, mitochondrial (atp5g2)
SEQ ID NO. 1436 RPL35-PpLuc(GC)-albumin7-A64-C30-histoneSL (FIG. 14)
SEQ ID NO. 1437 RPL21-PpLuc(GC)-albumin7-A64-C30-histoneSL (FIG. 15)
SEQ ID NO. 1438 ATP5A1-PpLuc(GC)-albumin7-A64-C30-histoneSL (FIG. 16)
SEQ ID NO. 1439 HSD17B4-PpLuc(GC)-albumin7-A64-C30-histoneSL (FIG. 17)
SEQ ID NO. 1440 AIG1-PpLuc(GC)-albumin7-A64-C30-histoneSL (FIG. 18)
SEQ ID NO. 1441 COX6C-PpLuc(GC)-albumin7-A64-C30-histoneSL (FIG. 19)
SEQ ID NO. 1442 ASAH1-PpLuc(GC)-albumin7-A64-C30-histoneSL (FIG. 20)
SEQ ID NO. 1443 mRPL21-PpLuc(GC)-albumin7-A64-C30-histoneSL (FIG. 37)
SEQ ID NO. 1444 mRPL35A-PpLuc(GC)-albumin7-A64-C30-histoneSL (FIG. 38)
SEQ ID NO. 1445 RPL35-PpLuc(GC)-A64-C30-histoneSL
SEQ ID NO. 1446 RPL21-PpLuc(GC)-A64-C30-histoneSL
SEQ ID NO. 1447 ATP5A1-PpLuc(GC)-A64-C30-histoneSL
SEQ ID NO. 1448 HSD17B4-PpLuc(GC)-A64-C30-histoneSL
SEQ ID NO. 1449 AIG1-PpLuc(GC)-A64-C30-histoneSL
SEQ ID NO. 1450 COX6C-PpLuc(GC)-A64-C30-histoneSL
SEQ ID NO. 1451 ASAH1-PpLuc(GC)-A64-C30-histoneSL
SEQ ID NO. 1452 5'UTR of human ribosomal protein Large 35 (RPL35) lacking the 5' terminal oligopyrimidine tract
SEQ ID NO. 1453 5'UTR of human ribosomal protein Large 21 (RPL21) lacking the 5' terminal oligopyrimidine tract
SEQ ID NO. 1454 5'UTR of human ATP synthase, H+ transporting, mitochondrial F1 complex, alpha subunit 1, cardiac muscle (ATP5A1) lacking the 5' terminal oligopyrimidine tract
SEQ ID NO. 1455 5'UTR of human hydroxysteroid (17-beta) dehydrogenase 4 (HSD17B4) lacking the 5' terminal oligopyrimidine tract
SEQ ID NO. 1456 5'UTR of human androgen-induced 1 (AIG1) lacking the 5' terminal oligopyrimidine tract
SEQ ID NO. 1457 5'UTR of human cytochrome c oxidase subunit VIc (COX6C) lacking the 5' terminal oligopyrimidine tract
SEQ ID NO. 1458 5'UTR of human N-acylsphingosine amidohydrolase (acid ceramidase) 1 (ASAH1) lacking the 5' terminal oligopyrimidine tract SEQ ID NO. 1459 5'UTR of mouse ribosomal protein Large 21 (mRPL21) lacking the 5' terminal oligopyrimidine tract SEQ ID NO. 1460 5'UTR of mouse ribosomal protein large 35A (mRPL35A) lacking the 5' terminal oligopyrimidine tract SEQ ID NO. 1461 Mouse ribosomal protein Large 21 (mRPL21)

SEQ ID NO. 1462 Mouse ribosomal protein large 35A (mRPL35A)

SEQ ID NO. 1463 RPL32-PpLuc(GC)-ag-A64 (FIG. 10)

SEQ ID NO. 1464-PpLuc(GC)-ag-A64-histoneSL (FIG. 9)

SEQ ID NO. 1465-PpLuc(GC) albumin7-A64-C30-histoneSL

SEQ ID NO. 1466 RPL35-PpLuc(GC)-ag-A64 (FIG. 22)

SEQ ID NO. 1467 RPL21-PpLuc(GC)-ag-A64 (FIG. 23)

SEQ ID NO. 1468 atp5a1-PpLuc(GC)-ag-A64 (FIG. 24)

SEQ ID NO. 1469 HSD17B4-PpLuc(GC)-ag-A64 (FIG. 25)

SEQ ID NO. 1470 AIG1-PpLuc(GC)-ag-A64 (FIG. 26)

SEQ ID NO. 1471 COX6C-PpLuc(GC)-ag-A64 (FIG. 27)

SEQ ID NO. 1472 ASAH1-PpLuc(GC)-ag-A64 (FIG. 28)

SEQ ID NO. 1473 RPL35-PpLuc(GC)-ag-A64-histoneSL (FIG. 29)

SEQ ID NO. 1474 RPL21-PpLuc(GC)-ag-A64-histoneSL (FIG. 30)

SEQ ID NO. 1475 atp5a1-PpLuc(GC)-ag-A64-histoneSL (FIG. 31)

SEQ ID NO. 1476 HSD17B4-PpLuc(GC)-ag-A64-histoneSL (FIG. 32)

SEQ ID NO. 1477 AIG1-PpLuc(GC)-ag-A64-histoneSL (FIG. 33)

SEQ ID NO. 1478 COX6C-PpLuc(GC)-ag-A64-histoneSL (FIG. 34)

SEQ ID NO. 1479 ASAH1-PpLuc(GC)-ag-A64-histoneSL (FIG. 35)

SEQ ID NO. 1480 RPL32-PpLuc(GC)-ag-A64-histoneSL (FIG. 11)

SEQ ID NO. 1481 RPL32-PpLuc(GC) albumin7-A64-C30-histoneSL (FIG. 13)

EXAMPLES

1. Preparation of DNA-Templates

A vector for in vitro transcription was constructed containing a T7 promoter followed by a GC-enriched sequence coding for *Photinus pyralis* luciferase (PpLuc(GC)) and an A64 poly(A) sequence. The poly(A) sequence was followed by a restriction site used for linearization of the vector before in vitro transcription. mRNA obtained from this vector accordingly by in vitro transcription is designated as "PpLuc (GC) A64".

This vector was modified to include untranslated sequences 5' or 3' of the open reading frame. In summary, vectors comprising the following mRNA encoding sequences have been generated:

SEQ ID No. 1364 PpLuc(GC)-ag-A64 (FIG. 6)

SEQ ID No. 1365 RPL32-PpLuc(GC)-ag-A64-C30-histoneSL (FIG. 7):

SEQ ID NO. 1436 RPL35-PpLuc(GC)-albumin7-A64-C30-histoneSL (FIG. 14)

SEQ ID NO. 1437 RPL21-PpLuc(GC)-albumin7-A64-C30-histoneSL (FIG. 15)

SEQ ID NO. 1438 ATP5A1-PpLuc(GC)-albumin7-A64-C30-histoneSL (FIG. 16)

SEQ ID NO. 1439 HSD17B4-PpLuc(GC)-albumin7-A64-C30-histoneSL (FIG. 17)

SEQ ID NO. 1440 AIG1-PpLuc(GC)-albumin7-A64-C30-histoneSL (FIG. 18)

SEQ ID NO. 1441 COX6C-PpLuc(GC)-albumin7-A64-C30-histoneSL (FIG. 19)

SEQ ID NO. 1442 ASAH1-PpLuc(GC)-albumin7-A64-C30-histoneSL (FIG. 20)

SEQ ID NO. 1443 mRPL21-PpLuc(GC)-albumin7-A64-C30-histoneSL (FIG. 37)

SEQ ID NO. 1444 mRPL35A PpLuc(GC)-albumin7-A64-C30-histoneSL (FIG. 38)

SEQ ID NO. 1445 RPL35-PpLuc(GC) A64-C30-histoneSL

SEQ ID NO. 1446 RPL21-PpLuc(GC) A64-C30-histoneSL

SEQ ID NO. 1447 ATP5A1-PpLuc(GC) A64-C30-histoneSL

SEQ ID NO. 1448 HSD17B4-PpLuc(GC) A64-C30-histoneSL

SEQ ID NO. 1449 AIG1-PpLuc(GC) A64-C30-histoneSL

SEQ ID NO. 1450 COX6C-PpLuc(GC) A64-C30-histoneSL

SEQ ID NO. 1451 ASAH1-PpLuc(GC) A64-C30-histoneSL

SEQ ID NO. 1463 RPL32-PpLuc(GC)-ag-A64 (FIG. 10)

SEQ ID NO. 1464-PpLuc(GC)-ag-A64-histoneSL (FIG. 9)

SEQ ID NO. 1465-PpLuc(GC)-albumin7-A64-C30-histoneSL

SEQ ID NO. 1466 RPL35-PpLuc(GC)-ag-A64 (FIG. 22)

SEQ ID NO. 1467 RPL21-PpLuc(GC)-ag-A64 (FIG. 23)

SEQ ID NO. 1468 atp5a1-PpLuc(GC)-ag-A64 (FIG. 24)

SEQ ID NO. 1469 HSD17B4-PpLuc(GC)-ag-A64 (FIG. 25)

SEQ ID NO. 0.1470 AIG1-PpLuc(GC)-ag-A64 (FIG. 26)

SEQ ID NO. 1471 COX6C-PpLuc(GC)-ag-A64 (FIG. 27)

SEQ ID NO. 1472 ASAH1-PpLuc(GC)-ag-A64 (FIG. 28)

SEQ ID NO. 1473 RPL35-PpLuc(GC)-ag-A64-histoneSL (FIG. 29)

SEQ ID NO. 1474 RPL21-PpLuc(GC)-ag-A64-histoneSL (FIG. 30)

SEQ ID NO. 1475 atp5a1-PpLuc(GC)-ag-A64-histoneSL (FIG. 31)

SEQ ID NO. 1476 HSD17B4-PpLuc(GC)-ag-A64-histoneSL (FIG. 32)

SEQ ID NO. 1477 AIG1-PpLuc(GC)-ag-A64-histoneSL (FIG. 33)

SEQ ID NO. 1478 COX6C-PpLuc(GC)-ag-A64-histoneSL (FIG. 34)

SEQ ID NO. 1479 ASAH1-PpLuc(GC)-ag-A64-histoneSL (FIG. 35)

SEQ ID NO. 1480 RPL32-PpLuc(GC)-ag-A64-histoneSL (FIG. 11)

SEQ ID NO. 1481 RPL32-PpLuc(GC)-albumin7-A64-C30-histoneSL (FIG. 13)

2. In Vitro Transcription

The DNA-template according to Example 1 was linearized and transcribed in vitro using T7-Polymerase. The DNA-template was then digested by DNase-treatment. mRNA transcripts contained a 5'-CAP structure obtained by adding an excess of N7-Methyl-Guanosine-5'-Triphosphate-5'-Guanosine to the transcription reaction. mRNA thus obtained was purified and resuspended in water.

3. Luciferase Expression by mRNA Lipofection

Human dermal fibroblasts (HDF) were seeded in 24 well plates at a density of $5 \times 10^4$ cells per well. The following day, cells were washed in opti-MEM and then transfected with 50 ng per well of Lipofectamine2000-complexed PpLuc-encoding mRNA in opti-MEM. As a control, mRNA not coding for PpLuc was lipofected separately. mRNA coding for *Renilla reniformis* luciferase (RrLuc) was transfected together with PpLuc mRNA to control for transfection efficiency (20 ng of RrLuc mRNA per well). 90 minutes after start of transfection, opti-MEM was exchanged for medium. 24, 48, 72 hours after transfection, medium was aspirated and cells were lysed in 200 µl of lysis buffer (25 mM Tris, pH 7.5 (HCl), 2 mM EDTA, 10% glycerol, 1% Triton X-100, 2 mM DTT, 1 mM PMSF). Lysates were stored at −20° C. until luciferase activity was measured.

Alternatively, HDF were seeded in 96 well plates one to three days before transfection at a density of $10^4$ cells per well. Immediately before lipofection, cells were washed in opti-MEM. Cells were lipofected with 25 ng of PpLuc-encoding mRNA per well complexed with Lipofectamine2000. In some experiments, mRNA coding for *Renilla reniformis* luciferase (RrLuc) was transfected together with PpLuc mRNA to control for transfection efficiency (2.5 ng of RrLuc mRNA per well). 90 minutes after start of transfection, opti-MEM was exchanged for medium. At various time points post transfection, medium was aspirated and cells were lysed in 100 µl of lysis buffer (Passive Lysis Buffer, Promega). Lysates were stored at −80° C. until luciferase activity was measured.

4. Luciferase Measurement

Luciferase activity was measured as relative light units (RLU) in a BioTek SynergyHT plate reader. PpLuc activity was measured at 15 seconds measuring time using 50 µl of lysate and 200 µl of luciferin buffer (75 µM luciferin, 25 mM Glycylglycin, pH 7.8 (NaOH), 15 mM MgSO4, 2 mM ATP). RrLuc activity was measured at 15 seconds measuring time using 50 µl of lysate and 200 µl of coelenterazin buffer (40 µM coelenterazin in phosphate buffered saline adjusted to 500 mM NaCl).

Alternatively, luciferase activity was measured as relative light units (RLU) in a Hidex Chameleon plate reader. PpLuc activity was measured at 2 seconds measuring time using 20 µl of lysate and 50 µl of luciferin buffer (Beetle-Juice, PJK GmbH). RrLuc activity was measured at 2 seconds measuring time using 20 µl of lysate and 50 µl of coelenterazin buffer (Renilla-Juice, PJK GmbH).

Results 5.1 the Combination of 5'UTR Elements Derived from 5'UTRs of TOP Genes and Histone Stem-Loop Increases Protein Expression Strongly.

To investigate the effect of the combination of a 5'UTR element derived from a 5'UTR of a TOP gene and a histone stem-loop (histoneSL) on protein expression from mRNA, mRNAs with different UTRs were synthesized: mRNAs either lacked both 5'UTR element and histoneSL, or contained both 5'UTR element and histoneSL. Luciferase-encoding mRNAs or control mRNA were transfected into human dermal fibroblasts (HDF). Luciferase levels were measured at 24 hours after transfection (see following Table 1 and FIG. 8).

TABLE 1

| mRNA | RLU at 24 hours |
|---|---|
| control RNA | 588 |
| PpLuc(GC)-ag-A64 | 12246 |
| RPL32-PpLuc(GC)-ag-A64-C30-histoneSL | 319840 |

Luciferase was clearly expressed from mRNA having neither 5'UTR element nor histoneSL. Strikingly however, the combination of 5'UTR element and histoneSL strongly increased the luciferase level. The magnitude of the rise in luciferase level due to combining 5'UTR element and histoneSL in the same mRNA indicates that they are acting synergistically.

5.2 the Combination of 5'UTR Elements Derived from 5'UTRs of TOP Genes and Histone Stem-Loop Increases Protein Expression from mRNA in a Synergistic Manner.

To investigate the effect of the combination of a 5'UTR element derived from a 5'UTR of a TOP gene and histone stem-loop on protein expression from mRNA, mRNAs with different UTRs were synthesized: mRNAs either lacked both 5'UTR element and histone stem-loop, or contained either a 5'UTR element or a histone stem-loop, or both 5'UTR element and histone stem-loop. Luciferase-encoding mRNAs were transfected into human dermal fibroblasts (HDF). Luciferase levels were measured at 8, 24, and 48 hours after transfection (see following Table 2 and FIG. 12).

TABLE 2

| mRNA | RLU at 8 hours | RLU at 24 hours | RLU at 48 hours |
|---|---|---|---|
| PpLuc(GC)-ag-A64 | 13110 | 25861 | 14362 |
| PpLuc(GC)-ag-A64-histoneSL | 88640 | 97013 | 57026 |
| rp132-PpLuc(GC)-ag-A64 | 155654 | 212245 | 102528 |
| rp132-PpLuc(GC)-ag-A64-histoneSL | 301384 | 425825 | 161974 |

Luciferase was clearly expressed from mRNA having neither 5'UTR element nor histone stem-loop. Both, either the histone stem-loop or the 5'UTR element increased luciferase levels compared to mRNA lacking both these elements. Strikingly however, the combination of 5'UTR element and histone stem-loop further strongly increased the luciferase level, much above the level observed with either of the individual elements. The magnitude of the rise in luciferase level due to combining 5'UTR element and histone stem-loop in the same mRNA demonstrates that they are acting synergistically.

The synergy between 5'UTR element and histone stem-loop was quantified by dividing the signal from mRNA combining both elements by the sum of the signal from mRNA lacking both elements plus the rise in signal effected by the 5'UTR element plus the rise in signal effected by the histone stem-loop. This calculation was performed for the three time points individually and for total protein expressed from 0 to 48 hours calculated from the area under the curve (AUC) (see following Table 3).

TABLE 3

| rp132 | histone S | RLU | Δ RLU | RLU predicted (additive) | synergy |
|---|---|---|---|---|---|
| | | 8h | | | |
| — | — | 13110 | | | |
| — | + | 88640 | 75530 | | |

TABLE 3-continued

| rp132 | histone S | RLU | Δ RLU | RLU predicted (additive) | synergy |
|---|---|---|---|---|---|
| + | — | 155654 | 142544 | | |
| + | + | 301384 | | 231184 | 1.30 |
| | | | 24 h | | |
| — | — | 25861 | | | |
| — | + | 97013 | 71152 | | |
| + | — | 212245 | 186384 | | |
| + | + | 425825 | | 283397 | 1.50 |
| | | | 48 h | | |
| — | — | 14362 | | | |
| — | + | 57026 | 42664 | | |
| + | — | 102528 | 88166 | | |
| + | + | 161974 | | 145192 | 1.12 |
| | | | AUC 0-48 hours | | |
| — | — | 846881 | | | |
| — | + | 3688000 | 2841119 | | |
| + | — | 7343000 | 6496119 | | |
| + | + | 14080000 | | 10184119 | 1.38 |

The synergy thus calculated specifies how much higher the luciferase level from mRNA combining 5'UTR element and histone stem-loop is than would be expected if the effects of 5'UTR element and histone stem-loop were purely additive. This result confirms that the combination of 5'UTR element and histone stem-loop effects a markedly synergistic increase in protein expression.

5.3 5'UTR Elements Derived from 5'UTRs of TOP Genes Increase Protein Expression from mRNA.

To investigate the effect of 5'UTR elements derived from 5'UTRs of TOP genes on protein expression from mRNA, mRNAs with one of different 5'UTR elements were synthesized. In addition, mRNAs contained the albumin? 3'UTR element. Luciferase-encoding mRNAs were transfected into human dermal fibroblasts (HDF). Luciferase levels were measured at 24, 48, and 72 hours after transfection (see following Table 4 and FIG. 21).

TABLE 4

| 5'UTR | RLU at 24 hours | RLU at 48 hours | RLU at 72 hours |
|---|---|---|---|
| none | 114277 | 121852 | 68235 |
| rpl32 | 332236 | 286792 | 114148 |
| rpl35 | 495917 | 234070 | 96993 |
| rpl21 | 563314 | 352241 | 156605 |
| atp5a1 | 1000253 | 538287 | 187159 |
| HSD17B4 | 1179847 | 636877 | 299337 |
| AIG1 | 620315 | 446621 | 167846 |
| COX6C | 592190 | 806065 | 173743 |
| ASAH1 | 820413 | 529901 | 198429 |

Luciferase was clearly expressed from mRNA lacking a 5'UTR element. Strikingly however, all 5'UTR elements strongly increased the luciferase level.

5.4 the Combination of 5'UTR Elements Derived from 5'UTRs of TOP Genes and Histone Stem-Loop Increases Protein Expression from mRNA in a Synergistic Manner.

To investigate the effect of the combination of 5'UTR elements derived from the 5'UTRs of TOP genes and histone stem-loop on protein expression from mRNA, mRNAs with different UTRs were synthesized: mRNAs either lacked both 5'UTR element and histone stem-loop, or contained a histone stem-loop, or contained one of different 5'UTR elements derived from 5'UTRs of TOP genes, or contained both one of different 5'UTR elements and a histone stem-loop. In addition, mRNAs contained the alpha-globin 3'UTR element. Luciferase-encoding mRNAs were transfected into human dermal fibroblasts (HDF). Luciferase levels were measured at 8, 24, and 48 hours after transfection (see FIG. 36). Luciferase was clearly expressed from mRNA having neither 5'UTR element nor histone stem-loop. The histone stem-loop increased the luciferase level. All 5'UTR elements also increased the luciferase level. Strikingly however, the combinations of 5'UTR element and histone stem-loop further strongly increased the luciferase level, much above the level observed with either of the individual elements. The magnitude of the rise in luciferase level due to combining 5'UTR element and histone stem-loop in the same mRNA demonstrates that they are acting synergistically.

The synergy between 5'UTR element and histone stem-loop was quantified by dividing the signal from mRNA combining both elements by the sum of the signal from mRNA lacking both elements plus the rise in signal effected by the 5'UTR element plus the rise in signal effected by the histone stem-loop. This calculation was performed for total protein expressed from 0 to 48 hours calculated from the area under the curve (AUC) (see following Table 5).

TABLE 5

| TOP 5'UTR | Synergy with histone stem-loop |
|---|---|
| 35 L | 2.50 |
| 21 L | 3.25 |
| atp5a1 | 3.00 |
| HSD17B4 | 3.55 |
| AIG1 | 1.52 |
| COX6C | 3.19 |

The synergy thus calculated specifies how much higher the luciferase level from mRNA combining 5'UTR element and histone stem-loop is than would be expected if the effects of 5'UTR element and histone stem-loop were purely additive. The luciferase level from mRNA combining 5'UTR element and histone stem-loop was up to more than three times higher than if their effects were purely additive. This result confirms that the combination of 5'UTR element and histone stem-loop effects a markedly synergistic increase in protein expression.

5.5 5'UTR Elements Derived from 5'UTRs of Mouse TOP Genes Increase Protein Expression from mRNA.

To investigate the effect of TOP 5'UTR elements derived from 5'UTRs of mouse TOP genes on protein expression from mRNA, mRNAs with two different mouse 5'UTR elements were synthesized. In addition, mRNAs contained the albumin7 3'UTR element. Luciferase-encoding mRNAs were transfected into human dermal fibroblasts (HDF). For comparison, mRNA containing the human rpl32 5'UTR element was transfected. Luciferase levels were measured at 24, 48, and 72 hours after transfection (see following Table 6 and FIG. 39).

TABLE 6

| 5'UTR | RLU at 24 hours | RLU at 48 hours | RLU at 72 hours |
|---|---|---|---|
| none | 114277 | 121852 | 68235 |
| rpl32 | 332236 | 286792 | 114148 |

TABLE 6-continued

| 5'UTR | RLU at 24 hours | RLU at 48 hours | RLU at 72 hours |
|---|---|---|---|
| mrpl21 | 798233 | 351894 | 139249 |
| mrpl35A | 838609 | 466236 | 174949 |

Luciferase was clearly expressed from mRNA lacking a 5'UTR element. Both mouse 5'UTR elements strongly increased the luciferase level, similarly as the human 5'UTR element.

Sequences:

*Homo sapiens* alpha-2-macroglobulin (A2M):
(Seq ID No: 1)
gctccttctttctg
caacatg

*Homo sapiens* acyl-CoA dehydrogenase, C-4 to C-12 straight chain (ACADM):
(Seq ID No: 2)
ggctctcttccgcgctgcggtcagcctcggcgtcccacagagagggccagaggtggaaa
cgcagaaaaccaaaccaggactatcagagattgcccggagaggggatg

*Homo sapiens* arylsulfatase E (chondrodysplasia punctata 1) (ARSE):
(Seq ID No: 3)
cttcctcttcttgatcggggattcaggaaggagcccaggagcagag
gaagtagagagagagacaacatg

*Homo sapiens* Bruton agammaglobulinemia tyrosine kinase (BTK):
(Seq ID No: 4)
tgtccttcctctctggactgtaagaatatgtctccagggccag
tgtctgctgcgatcgagtcccaccttccaagtcctggcatctcaatgcatctgggaagc
tacctgcattaagtcaggactgagcacacaggtgaactccagaaagaagaagctatg

*Homo sapiens* complement component 2 (C2):
(Seq ID No: 5)
tgac
cttttcccctcccgcggctctctacctctcgccgcccctagggaggacaccatg

*Homo sapiens* cyclin-dependent kinase 4 (CDK4):
(Seq ID No: 6)
gggcctctctagcttgcggcctgtgtctatggtcgggccctctgcgtccagctgctccg
gaccgagctcgggtgtatggggccgtaggaaccggctccggggcccccgataac
gggccgcccccacagcaccccgggctggcgtgagggtctcccttgatctgagaatg

*Homo sapiens* cytochrome P450, family 17, subfamily A, polypeptide 1 (CYP17A1):
(Seq ID No: 7)
agctcttctactccactgctgtctatcttgcctgccggcacc
cagccaccatg

*Homo sapiens* endoglin (ENG):
(Seq ID No: 8)
cttcctctacccggttgg
caggcggcctggcccagcccctttctctaaggaagcg
catttcctgcctccctgggccggccgggctggatg

*Homo sapiens* excision repair cross-complementing rodent repair deficiency, complementation group 3 (ERCC3):
(Seq ID No: 9)
tcttctctctgctgctgtagctgccatg

*Homo sapiens* excision repair cross-complementing rodent repair deficiency, complementation group 5 (ERCC5):
(Seq ID No: 10)
ctgtctttcttccgggaggcggtgacagctgctgagacgtgttgcagccagag
tctctccgctttaatgcgctcccattagtgccgtcccccactggaaaac -continued cgtggcttctgtattatttgccatctttgttgtgtaggag
cagggagggcttcctcccggggtcctaggcggcggtgcagtccgtcgtagaagaatt
agagtagaagttgtcggggtccgctcttaggacgcagccgcctcatg

*Homo sapiens* ferritin, light polypeptide (FTL):

(Seq ID No: 11)

cgtcccctcgcagttcggcggtccgcgggtctgtctcttgcttcaacagtgtttggacg
gaacagatccggggactctcttccagcctccgaccgccctccgatttcctctccgcttgc
aacctccgggaccatcttctcggccatctcctgcttctgggacctgccagcaccgtttttt
gtggttagctccttcttgccaaccaaccatg

*Homo sapiens* galactosylceramidase (GALC):

(Seq ID No: 12)

ccgcctccctgggcgccggagtcatgtgacccacacaatg

*Homo sapiens* gap junction protein, alpha 1, 43 kDa (GJA1):

(Seq ID No: 13)

ttttctttcattaggggaaggcgtgaggaaagtaccaaacagcagcggag
ttttaaactttaaatagacaggtctgagtgcctgaactt
gccttttcattttacttcatcctccaaggagttcaatcacttggcgtgacttcac
tacttttaagcaaaagagtggtgcccaggcaacatg

*Homo sapiens* gap junction protein, beta 1, 32 kDa (GJB1):

(Seq ID No: 14)

cattctctgggaaagggcagcagcagccaggtgtggcag
tgacagggaggtgtgaatgaggcaggatg

*Homo sapiens* glucose-6-phosphate isomerase (GPI):

(Seq ID No: 15)

cgctccttcctcctcggctcgcgtctcactcagtgtaccttctagtcccgccatg

*Homo sapiens* hydroxyacyl-CoA dehydrogenase/3-ketoacyl-CoA thiolase/enoyl-CoA hydratase (trifunctional protein), alpha subunit (HADHA):

(Seq ID No: 16)

ctgtcctcttcagctcaa
gatg

*Homo sapiens* hydroxyacyl-CoA dehydrogenase/3-ketoacyl-CoA thiolase/enoyl-CoA hydratase (trifunctional protein), beta subunit (HADHB):

(Seq ID No: 17)

gggccctttctgggcag
gacccgcccttggtcccgcagagccttggtacttggacctgaaccttgctccga
gagggagtcctcgcggacgtcagccaagattccagaatg

*Homo sapiens* complement factor H (CFH):

(Seq ID No: 18)

cttccttttgcag
caagttctttcctgcactaatcacaattcttggaagaggagaactggacgtt
gtgaacagagttagctggtaaatgtcctcttaaaagatccaaaaaatg

*Homo sapiens* sarcoglycan, gamma (35 kDa dystrophin-associated glycoprotein) (SGCG):

(Seq ID No: 19)

agcccttttctccagggacagttgctgaagcttcatcctttgctctcattctg
taagtcatagaaaagtttgaaacattctgtctgtggtagagctcgggccagctgtag
ttcattcgccagtgtgcttttcttaatatctaagatg

*Homo sapiens* lipase A, lysosomal acid, cholesterol esterase (LIPA):

(Seq ID No: 20)

ggtcccctatccgcaccccggcccctgagagctggcactgcgactcgaga
cagcggcccggcaggacagctccagaatg

*Homo sapiens* lipoprotein lipase (LPL):

(Seq ID No: 21)

ccccctcttcctcctcctcaagggaaagctgcccacttctagctgccctgccatcccctt
taaagggcgacttgctcagcgccaaac
cgcggctccagccctctccagcctccggctcagccggctcatcagtcggtccgcgcctt
gcagctcctccagagggacgcgccccgagatg

*Homo sapiens* mutL homolog 1, colon cancer, nonpolyposis type 2 (*E. coli*) (MLH1):

(Seq ID No: 22)

ggctcttctggcgccaaaatg

-continued

*Homo sapiens* Niemann-Pick disease, type C1 (NPC1):

(Seq ID No: 23)

cttccttcctgaccggcgcgcg
cagcctgctgccgcggtcagcgcctgctcctgctcctccgctcctcctgcgcggggtgct
gaaacagcccggggaagtagagccgcctccggggagcccaaccagccgaac
gccgccggcgtcagcagccttgcgcggccacagcatg

*Homo sapiens* peroxisomal biogenesis factor 12 (PEX12):

(Seq ID No: 24)

gcgcctctcttccgccaggcatcccagaggtcctggtggtttcatttccgggtgcggctt
ctgtcataaagcggagacctcccttcaaacgtggcgtcgtgggttgttt
gcgcctcgcctggggtcagcgagcaaggacgggcgcgggcggggatactcaaa
gccaacagctggagtcagcccttgtgtcccgggctcacagtggcac
gactgaatcctcagagtcggctggcttttgagctctcacgattggggag
gaggggggcgtttctggttcgcagctccagag
gattgcgttccttcccccatacctgtcccccacagtcacgctctgccctgacgtgcag
catttgacaagttaccccctcgccacatactacttccacccacgtccgagttaacttt
gttcttaaccttcttgagactaccctcggcctccaggtctttttttcccag
ttcatttttgcccataagattgagtttcgagtttcagatatcatgcagaaagtttac
ctttaagactgagcacccatctgatactcttcctcccgaaaaagttcatgctcacgaga
gagtttgtgggaaaagtgaaagccagtacacgcaggaaactatg

*Homo sapiens* peroxisomal biogenesis factor 6 (PEX6):

(Seq ID No: 25)

cgctccttcaccctcctcgttggtgtcctgtcaccatg

*Homo sapiens* phosphofructokinase, muscle (PFKM):

(Seq ID No: 26)

gagccttctt
gtcagcatctgttagtggaggttgggaagcctctcctcctccccctccctcttt
gcctccac
ctggctcctccccatgttcgtccatcaccccctccccctttcccaaggacaatctgcaa
gaaagcagcggcggaggagagctaagactaaaagagtggatcatg

*Homo sapiens* serpin peptidase inhibitor, clade A (alpha-
1 antiproteinase, antitrypsin), member 1 (SERPINA1):

(Seq ID No: 27)

ctgtctcctcagcttcaggcaccaccactgacctgggacagtgaatcgacaatg

*Homo sapiens* phosphatase and tensin homolog (PTEN):

(Seq ID No: 28)

agttctctcctctcggaagctgcagccatgatggaagtttgagagttgagccgctgtgag
gcgaggccgggctcaggcgagggagatgagagacggcggcggccgcggcccggagcccct
ctcagcgcctgtgagcagccgcgggggcagcgccctcggggagccggccggcctgcggcg
gcggcagcggcggcgtttctcgcctcctcttcgtcttttctaaccgtgcagcctcttcct
cggcttctcctgaaagggaaggtgaagccgtgggctcgggcgggagccggctgaggcgc
ggcggcggcggcggcacctcccgctcctggagcgggggggagaagcggcggcggcggcgg
ccgcggcggctgcagctccagggagggggtctgagtcgcctgtcaccatttccaggctg
ggaacgccggagagttggtctctcccttctactgcctccaacacggcggcggcggcggc
ggcacatccagggacccgggccggttttaaacctcccgtccgccgccgccgcacccccg
tggcccgggctccggaggccgccggcggaggcagccgttcggaggattattcgtcttctc
cccattccgctgccgccgctgccaggcctctggctgctgaggagaagcaggcccagtcgc
tgcaaccatccagcagccgccgcagcagccattaccggctgcggtccagagccaagcgg
cggcagagcgaggggcatcagctaccgccaagtccagagccatttccatcctgcagaaga
agccccgccaccagcagcttctgccatctctctcctcctttttcttcagccacaggctcc
cagacatg

*Homo sapiens* solute carrier family 3 (cystine,
dibasic and neutral amino acid transporters, activator
of cystine, dibasic and neutral amino acid transport), member
1 (SLC3A1):

(Seq ID No: 29)

cctcccttactgcaggaaggcactccgaagacataagtcggtga
gacatg

*Homo sapiens* aldehyde dehydrogenase 3 family, member A2
(ALDH3A2):

(Seq ID No: 30)

ccgcctcccactccccagcgccccccggaccgtgcagttctctgcag
gaccaggccatg

*Homo sapiens* bleomycin hydrolase (BLMH):

(Seq ID No: 31)

gtttctcccagcctcagcctccccgccgccgccgccgccgccgagccggtttcc
tttttccggcgctccgggtgcgagagacaggtcgggcccctaggcagcgagccg
cagcgcaatcccggcgctcgcccaaggaccctggaagctaccgttaccccgccggg
cagcgtgggcgccatg -continued

*Homo sapiens* cathepsin K (CTSK):

(Seq ID No: 32)

cctcctcctcttacccaaattttccagccgatcactggagctgacttccg
caatcccgatggaataaatctagcaccctgatggtgtgcccacacttt
gctgccgaaacgaagccagacaacagatttccatcagcaggatg

*Homo sapiens* GM2 ganglioside activator (GM2A):

(Seq ID No: 33)

gcttctttgcg
taaccaatactggaaggcatttaaaggcacctctgccgccacagaccttgcag
ttaactccgccctgacccaccttcccgatg

*Homo sapiens* hydroxysteroid (17-beta) dehydrogenase 4
(HSD17B4):

(Seq ID No: 34)

ccgcctcctcctgtcccgcagtcggcgtccagcggctctgctt
gttcgtgtgtgtgtcgttgcaggccttattcatg

*Homo sapiens* neutrophil cytosolic factor 2 (NCF2):

(Seq ID No: 35)

ctctctctgcttctttcctttctctctcatggtaggtttatgagtcagttgccaaaagg
tggggacatttcctgatgcatttgcaacactgagaagttatcttaagggaggctgggccc
cattctactcatctggcccagaaagtgaacacctggggggccactaaggcagccctgcta
ggggagacgctccaacctgtcttctctctgtctcctggcagctctcttggcctcctagtt
tctacctaatcatg

*Homo sapiens* 3-oxoacid CoA transferase 1 (OXCT1):

(Seq ID No: 36)

cagcctcctcctgcctcaccgcccgaagatg

*Homo sapiens* sulfite oxidase (SUOX):

(Seq ID No: 37)

ccgccccttctcgagaactcg
cagagctgggctggtaaaattgcagtgctgaagacactggacccg
caaaaggctgtccctcccaaacctgggattctgggctcactgagttcacctgcgag
tcagccctacctgcactgctctggtctagtacaaacaggctgctggcattgagggac
ggagtctccaactcctggcctctagcagtcctcctgtgtaggtctcccaaagtgctag
tgtgtccggaattggtgggttcttggtctcactgacttcaagaatgaagccgcg
gaccctcgcagtctgctacaatg

*Homo sapiens* albumin (ALB):

(Seq ID No: 38)

ttttctcttctgtcaaccccca
cacgcctttggcacaatg

*Homo sapiens* arylsulfatase A (ARSA):

(Seq ID No: 39)

ctccctctagcgccttcccccggcccgactccgctggtcagcgccaagtgacttac
gcccccgaccctgagcccggaccgctaggcgaggaggatcagatctccgctcga
gaatctgaaggtgccctggtcctggaggagttccgtcccagccgcggtctcccgg
tactgtcgggccccggccctctggagcttcaggaggcggccgtcagggtcggggag
tatttgggtccggggtctcaggaagggcggcgcctgggtctgcggtatcggaaa
gagcctgctggagccaagtagcccctcctctcttgggacagacccctcggtcccatg

*Homo sapiens* elastin (ELN):

(Seq ID No: 40)

ctccctccctctttccctcacagccgac
gaggcaacaattaggctttggggataaaacgaggtgcggagagcgggctgggg
catttctccccgagatg

*Homo sapiens* hemoglobin, alpha 2 (HBA2):

(Seq ID No: 41)

cactcttctggtcccca
cagactcagagagaacccaccatg

*Homo sapiens* hexosaminidase B (beta polypeptide) (HEXB):

(Seq ID No: 42)

cttcctctgatccgggccggcgggaagtcgggtcccgaggctccggctcggcagac
cgggcggaaagcagccgagcggccatg

*Homo sapiens* mannosidase, alpha, class 2B, member 1
(MAN2B1):

(Seq ID No: 43)

cggcctttccagggccggggaaccccaggaggaagctgctgagccatg

*Homo sapiens* recombination activating gene 2 (RAG2):

(Seq ID No: 44)

cac
tctctttacagtcagccttctgcttgccacagtcatagtgggcagtcag
tgaatcttccccaagtgctgacaattaatacctggtttagcggcaaagattcaga
gaggcgtgagcagcccctctggccttcagacaaaaatctacgtaccatcagaaactatg

*Homo sapiens* CD53 molecule (CD53):

(Seq ID No: 45)

tctccttttacacaaatagccccg
gatatctgtgttaccagccttgtctcggccacctcaaggataatcac
taaattctgccgaaaggactgaggaacggtgcctggaaaagggcaagaatatcacgg
catg

*Homo sapiens* Fc fragment of IgG, low affinity IIIa, receptor (CD16a) (FCGR3A):

(Seq ID No: 46)

tggtccctttagggctccggatatctttggtgacttgtc
cactccagtgtggcatcatg

*Homo sapiens* interleukin 1, beta (IL1B):

(Seq ID No: 47)

aaac
ctcttcgaggcacaaggcacaacaggctgctctgggattctcttcagccaatcttcatt
gctcaagtgtctgaagcagccatg

*Homo sapiens* CD4 molecule (CD4):

(Seq ID No: 48)

ctgtctctcttcatttaagcac
gactctgcagaaggaacaaagcaccctcccccactgggctcctggtt
gcagagctccaagtcctcacacagatacgcctgtttgagaagcagcgggcaagaaagac
gcaa
gcccagagggcctgccatttctgtgggctcaggtccctactggctcaggcccctgcctcc
ctcggcaaggccacaatg

*Homo sapiens* serpin peptidase inhibitor, Glade A (alpha-1 antiproteinase, antitrypsin), member 5 (SERPINA5):

(Seq ID No: 49)

agccctctgcccttctgagcccgagggactgccacctccactgtgtgcacactcagc
tacgggacacatttcaggtatccaaggcagcagaggtgag
tgggtccccgagctctgtgaccttatgctccacactaactctgg
cagagcctccgtttcctcatagaacaaagaacagccaccatg

*Homo sapiens* vitronectin (VTN):

(Seq ID No: 50)

tgccctccttccctgtctctgcctctccctcccttcctcaggcatcagagcgga
gacttcagggagaccagagcccagcttgccaggcactgagctagaagccctgccatg

*Homo sapiens* aldehyde dehydrogenase 9 family, member A1 (ALDH9A1):

(Seq ID No: 51)

ccgcccctcccgcggcccgccccctcccgcgggcccgtcagcctctgccgcg
gagctgcgtccgccactcatg

*Homo sapiens* annexin A1 (ANXA1):

(Seq ID No: 52)

cttcctttaaaatcc
tataaaatcagaagcccaagtctccactgccagtgtgaaatcttcagagaa
gaatttctctttagttctttgcaagaaggtagagataaagacacttttttcaaaaatg

*Homo sapiens* ATPase, Na+/K+ transporting, alpha 1 polypeptide (ATP1A1):

(Seq ID No: 53)

ttttctctctgattctccagcgacaggacccggcgccgggcactgag
caccgccaccatg

*Homo sapiens* ATPase, Na+/K+ transporting, alpha 2 polypeptide (ATP1A2):

(Seq ID No: 54)

ctttctctgtctgccagggtctccgactgtcccagac
gggctggtgtgggcttgggatcctcctggtgacctctcccgctaaggtccctcagccac
tctgccccaagatg

*Homo sapiens* calcium channel, voltage-dependent, beta 3 subunit (CACNB3):

(Seq ID No: 55)

ccctccttcgcgctctctcgctccctgccgccgcccgcagggctgcggggctcggtggca
tctcccgggcgcggcccgcagtcctt -continued gccctgcctccgggccgctcccgcccccggcgccgctcgctcccccgacccg
gactcccccatg Homo sapiens cholinergic receptor, nicotinic, alpha 7 (neuronal)
(CHRNA7):

(Seq ID No: 56)

gtgcctctgtggccgcaggcgcaggcccgggcgacagccga
gacgtggagcgcgccggctcgctgcagctccgggactcaacatg Homo sapiens
cytochrome P450, family 51, subfamily A, polypeptide
1 (CYP51A1):

(Seq ID No: 57)

gcttctctcgttccgtcgattgggaggagcggtggcgac
ctcggccttcagtgtttccgacggagtgaatg

Homo sapiens glutamate decarboxylase 1 (brain, 67 kDa)
(GAD1):

(Seq ID No: 58)

atctctctcttctcctggcgctcgcgtgcgagagggaactagcgagaac
gaggaagcagctggaggtgacgccgggcagattacgcctgtcagggccgagccgagcg
gatcgctgggcgctgtgcagaggaaaggcgggagtgcccggctcgctgtcg
cagagccgagcctgtttctgcgccggaccagtcgaggactctggacag
tagaggccccgggacgaccgagctgatg Homo sapiens gamma-glutamyl carboxylase (GGCX):

(Seq ID No: 59)

aattctcctggcggcctccgttcagacgcggcagctgtgacccacctgcctcctccg
cagagcaatg

Homo sapiens glutamate receptor, metabotropic 3 (GRM3):

(Seq ID No: 60)

tccctctttccccaacctcctccctctcttctactccaccctccgttttcccac
tcccactgactcggatgcctggatgttctgccaccgggcagtggtccagcgtg
cagccgggaggggcaggggcactgtgacaggaagctgcgcgcacaagtt
ggccatttcgagggcaaaataagttctcccttggatttggaaaggacaaagccagtaa
gctacctcttttgtgtcggatgaggaggaccaaccatgagccagagcccgggtg
caggctcaccgcgccgctgccaccgcggtcagctccagttcctgccaggagtt
gtcggtgcgaggaattttgtgacaggctctgttagtctgttcctcccttattt
gaaggacaggccaaagatccagtttggaaatgagagaggactagcatgacacatt
ggctccaccattgatatctcccagaggtacagaaacaggattcatgaagatg Homo sapiens guanylate cyclase 1, soluble, alpha 3
(GUCY1A3):

(Seq ID No: 61)

ggttcctttgggtgatcaaagagggagacacagacacagagagacaaaggcaaggagga
ctgtctgggagccacgcgggcgatacagtttccgaggcacgccgcgtcccgcctagcctg
ttgaacaggtagacatgagcgacccaagctgcggatttgcgaggcgccgcccctggagctgc
tagagatccggaagcacagcccccgaggtgtgcgaagccaccaagtcaagttcctaacgag
tcttcagaggaggcagcaggaagctcagagagctgcaaagcaaccgtgcccatctgtcaa
gacattcctgagaagaacatacaagaaagtcttcctcaaagaaaaaccagtcggagccga
gtctatcttcacactttggcagagagtatttgcaaactgattttcccagagtttgaacgg
ctgaatgttgcacttcagagaacattggcaaagcacaaaataaaagaaagcaggaaatct
ttggaaagagaagactttgaaaaaacaattgcagagcaagcagttgcagcaggagttcca
gtggaggttatcaaagaatctcttggtgaagaggttttaaaatatgttacgaggaagat
gaaaacatcctggggtggttggaggcacccttaaagatttttaaacagcttcagtacc
cttctgaaacagagcagccattgccaagaagcaggaaaaaggggcaggcttgaggacgcc
tccattctatgcctggataaggaggatgattttctacatgtttactacttcttccctaag
agaaccacctccctgattcttcccggcatcataaaggcagctgctcacgtattatatgaa
acggaagtggaagtgtcgttaatg Homo sapiens 3-hydroxy-3-methylglutaryl-CoA reductase
(HMGCR):

(Seq ID No: 62)

ggctccttccgctccgcgactgcgttaactg
gagcaggctgagcgtcggcgccggggttcggtggcctctagtgagatctggag
gatccaaggattctgtagctacaatg Homo sapiens IMP (inosine 5'-monophosphate) dehydrogenase 2
(IMPDH2):

(Seq ID No: 63)

aggtctctgcggcgcggtcctcggagacacgcggcggtgtcctgtgtt
ggccatg

Homo sapiens leukotriene A4 hydrolase (LTA4H):

(Seq ID No: 64)

acttcctttcccggcgtgcaccgcgaatccctcctcctcttctttac
ctctctccctcctcctcaggttctctatcgacgagtctggtagctgagcgttgggctg
taggtcgctgtgctgtgtgatcccccagagccatg -continued

*Homo sapiens* neuropeptide Y receptor Y1 (NPY1R):

(Seq ID No: 65)

ccttctttaa
taagcaggagcgaaaaagacaaattccaagaggattgttcagttcagggaatgaa
gaattcagaataattttggtaaatggattccaatatggggaataagaataa
gctgaacagttgacctgctttgaagaaacatactgtccatttgtctaaaa
taatctataacaaccaaaccaatcaaaatg

*Homo sapiens* pyruvate dehydrogenase (lipoamide) beta (PDHB):

(Seq ID No: 66)

cggcccctctgttgtcgtttggcagcggatagaggacacgaccaagatg

*Homo sapiens* ribosomal protein L36a-like (RPL36AL):

(Seq ID No: 67)

cttccctttcctgttaggcgagagctgcgaaaggcga
gagctgcgaagggccaggtgtcgggcgctgtttctcgttttcatcatataga
caaaacagccctgctgcaaagatg

*Homo sapiens* ATPase, Ca++ transporting, type 2C, member 1 (ATP2C1):

(Seq ID No: 68)

gcttcttctcacgccgggagcaggctcccgcctcgcac
cgctgcccgcgag
cagctcctcttctcccgaggcgcgcggggcgcccccgcgagccccgcggctga
gaccccgcagcctggaggagggctgtccggggcttt
ggatgctgctgctaggggtggtgggagcagccgtgggacgcgtggccgg
gagcgggggtgacagcctgggattccgggggcttctcttccctt
gtcctcctcctctcctctctattcccagtgtggccgtggctgacactaaagacttt
gtagccatcaacccgagtgcagtttcgatggaaaatg

*Homo sapiens* UDP-glucose pyrophosphorylase 2 (UGP2):

(Seq ID No: 69)

ccgcctctttcattgaagaaatttaagttcgtgtggttttaccttttccgggagtctcca
gctggccctcatttgtgtccggagctcaggagttcccaaaccgactcagtcgcaccaagt
ttccgtctttggaattggggaaggagtttctttctttcttttcttttttcttgagccag
ttttaatcgctttgaataaatactcccttaagtagttaaatataggaggagaaagaatac
atcggttgttaaagcaggagaggaagagagacctgccctgtagcgtgactcctctagaaa
aaaaaaaaaaagccggagtattttactaagcccctaaaatg

*Homo sapiens* ATPase, Na+/K+ transporting, beta 1 polypeptide (ATP1B1):

(Seq ID No: 70)

cctcctcctgctcctgccttggctcctccgccgcgcgtctcgcac
tccgagagccgcagcggcagcggcgcgtcctgcctgcagagagccaggccggagaa
gccgagcggcgcagaggacgccagggcgcgcgccgcagccacccaccctccggac
cgcggcagctgctgacccgccatcgccatg

*Homo sapiens* glycoprotein M6B (GPM6B):

(Seq ID No: 71)

ctgtctttatggaccag
taggcagagcgaaattgacgctgacaagacttttgcatcttggaagggactg
taatctactgtagtgaagaacagagcctctcaatcagacgggtgtaaataagagac
ggaggggagtccaaaagaaaaggaagaggaggaaaaacaagtgtgtgttggggg
gaacagggggaaaagcattttttggtggatggtatg

*Homo sapiens* wntless homolog (*Drosophila*) (WLS):

(Seq ID No: 72)

gctcctttaa
gcgtccacaggcggcggagcggccacaatcacagctccgggcattgggg
gaacccgagccggctgcgccgggg
gaatccgtgcgggcgccttccgtcccggtcccatcctcgccgcgctccagcac
ctctgaagttttgcagcgcccagaaaggaggcgaggaaggagggagtgtgtgagag
gagggagcaaaaagctcaccctaaaacatttatttcaaggagaaaa
gaaaaaggggggcgcaaaaatg

*Homo sapiens* flavin containing monooxygenase 3 (FMO3):

(Seq ID No: 73)

ttttctctttcaaactgcccagacggttggacaggacgtagacacacagaagaaaa
gaagacaaagaacgggtaggaaaattaaaaaggttaccatg

*Homo sapiens* multiple C2 domains, transmembrane 1 (MCTP1):

(Seq ID No: 74)

cagcctcttttgccggtattcagtgaagaaagcaagtctaaatatgcagttctctcac
tggagtgaaagatgttttgttcatttctaatcaactatg

*Homo sapiens* structural maintenance of chromosomes 4 (SMC4):

(Seq ID No: 75)

ccgcctctcggcgagcccgccctcttctgaagaggcgtttctggaccac
tgagcccgcctcccactgtgagcggaaccctac
cgttttttaaaaaaatctttttcaaaacttgccaggttgtctttccaaatattttaa -continued taatagtgctgctgctgtagaccacagagaaaagaatccctcgctcttccttttcac
ttagtagaaacttctaccgcgtaggtcccgccaggagttcgcgcatgcgcag
gagcgacaataagatggcggtgataatcgccgcacttttttttcaaattagtg
gatcccagaaatcattgcgcgcatttgtaacgaatttccgttcgagttt
gtattttaggcgccattttcgagtgaaggacccggagccgaaacaccggtaggagcggg
gaggtgggtactacacaaccgtctccagccttggtctgagtggactgtcctgcagcgac
catg

*Homo sapiens* GLE1 RNA export mediator homolog (yeast)
(GLE1):

(Seq ID No: 76)

tggccttcccggcggctgattcgagggcttgtttggtcagaaggggggcgtcagagaagc
tgcccttagccaaccatg

*Homo sapiens* tripartite motif containing 6 (TRIM6):

(Seq ID No: 77)

gag
tctttcggcctgggtggaggacgcggctgcttcaagtcctt
ggctctgatccaggccacagattccaggattctacaggcaggaaacatctta
gaaatcagggttgggcaggcaggagccaggagagtagctacaatg

*Homo sapiens* ecotropic viral integration site 2A (EVI2A):

(Seq ID No: 78)

tatccttttttactgcagatttactttaaggctcatattctccaagtc
tattctgctttaaaaagaagacaagaaaagaagtggtttatcaaaatcac
gttataatcagattttgaccaagcattttgtaagtatacaaatgtcagccaatgacata
taacaaccatttcttataaaaaccttgatgttcaaaagcctgactagcagtggcatccatg

*Homo sapiens* heterogeneous nuclear ribonucleoprotein L
(HNRNPL):

(Seq ID No: 79)

tgctcttttcgatccgggacggccggtcaggctcgccgccgagctgga
gaactacgatgacccgcacaaaaccctgcctccccagtt
gtccacatcaggggcctgattgacggtgtggtggaagcagaccttgtggaggcctt
gcaggagtttggacccatcagctatgtggtggtaatg

*Homo sapiens* mitochondrial translational initiation factor 2
(MTIF2):

(Seq ID No: 80)

cattcttccgggtccagaaggtgatctccgcccgtgctcagaatccaggggcccggggct
gtagattccttgacaaggatatcctagcggcgaaacaacaccgtactgggagtcagaac
gtctggttctagtcttgactgccattaactagcggtatgacattggagaagctttttt
gaccttctggatttccgtttccttttctgtaaaatgaggagcttggaagatccg
gaaaatgaggcccataggaaacaagtgacttgctgagtccagataacac
tgactgtcagagagaaacatg

*Homo sapiens*
nuclear factor of kappa light polypeptide gene enhancer
in B-cells inhibitor, zeta (NFKBIZ):

(Seq ID No: 81)

tggcctcctctt
gccacgaggtcagacggcgagttcttaga
gaaaaaggctgcttagctgctgcttatcatgtaac
ctcaaaaggaaactgatcgtcttctcatgctgtcacgtactt
gggttattatcgctgattacagctggaaacaattgatttgctcttacgtattt
gtgtgacttgactcttcaaacacaaaggttaacaggaa
gatctcgagggccctggctgaacttcaccttttggctttctt
ggcctgatgctgaactctcgaggttgagccccatatg

*Homo sapiens*
v-erb-b2 erythroblastic leukemia viral oncogene homolog
3 (avian) (ERBB3):

(Seq ID No: 82)

atccctccccg
gactccggctccggctccgattgcaatttgcaacctccgctgccgtcgccgcag
cagccaccaattcgccagcggttcaggtggctctt
gcctcgatgtcctagcctaggggcccccgggccggactt
ggctgggctcccttcaccctctgcggagtcatg

*Homo sapiens* podoplanin (PDPN):

(Seq ID No: 83)

ccgcctcctcgggagagataaatg

*Homo sapiens* ribonucleotide reductase M1 (RRM1):

(Seq ID No: 84)

gcgccccttt
gtgcgtcacgggtggcgggcgcgggaaggggatttggattgttgcgcctctgctctgaa
gaaagtgctgtctggctccaactccagttctttccctgagcagcgcctggaac
ctaacccttcccactctgtcaccttctcgatcccgccggcgctttagagccgcag
tccagtcttggatccttcagagcctcagccactagctgcgatg -continued

*Homo sapiens* solute carrier family 2 (facilitated
glucose transporter), member 4 (SLC2A4):

(Seq ID No: 85)

gcgtcttttcccccagcccgctccaccagatccgcgggagccccac
tgctctccgggtccttggcttgtggctgtgggtcccatcgggcccgccctcgcac
gtcactccgggaccccgcggcctccgcaggttctgcgctccaggccggagtcaga
gactccaggatcggttctttcatcttcgccgccctgcgcgtccagctcttctaagac
gagatg

*Homo sapiens* steroid-5-alpha-reductase, alpha polypeptide 1
(3-oxo-5 alpha-steroid delta 4-dehydrogenase alpha 1)
(SRD5A1):

(Seq ID No: 86)

aacccttctgcagagtcccggcagtgcgggactccgg
tagccgcccctccggtagccgccctcctgccccgcgccgccgccctatatgtt
gcccgccgcggcctctggggcatggagcacgctgcccagccctggcgatg

*Homo sapiens* thromboxane A synthase 1 (platelet) (TBXAS1):

(Seq ID No: 87)

gttcccttttctacctgcagagcacggttcccataagggcggcga
gatcagcctcctgtctcatctggaagaccaccactctggggtctcagaggaatg

*Homo sapiens* transketolase (TKT):

(Seq ID No: 88)

ctatctctgtgtgtccgcgtgtgcgcccggtccccgcctgccgcaccatg

*Homo sapiens*
tumor necrosis factor receptor superfamily, member
1A (TNFRSF1A):

(Seq ID No: 89)

cctcctcctccagctcttcctgtcccgctgttgcaacac
tgcctcactcttcccctcccac
cttctctcccctcctctctgctttaattttctcagaattctctggactgaggctccag
ttctggcctttggggttcaagatcactgggaccaggccgtgatctctatgcccgag
tctcaaccctcaactgtcaccccaaggcacttgggacgtcctggacagaccgag
tcccgggaagcccagcactgccgctgccacactgccctgagcccaaatgggggagtga
gaggccatagctgtctggcatg

*Homo sapiens* tubulin, beta 2A class IIa (TUBB2A):

(Seq ID No: 90)

ag
gtctctgcgcagcccagcccgccggtccacgccgcgcac
cgctccgagggccagcgccaccgctccgcagccggcaccatg

*Homo sapiens* actin, beta (ACTB):

(Seq ID No: 91)

tcgcctttt
gccgatccgccgcccgtccacacccgccgccagctcaccatg

*Homo sapiens* adenylosuccinate synthase (ADSS):

(Seq ID No: 92)

ggctccttcttcctctgcatgtggctggcggccgcagagcagttcagttcgctcac
tcctcgccggccgcctctccttcgggctctcctcgcgtcactggagccatg

*Homo sapiens* alanyl (membrane) aminopeptidase (ANPEP):

(Seq ID No: 93)

cgttctctgcctggcctgaggctccctgagccgcctccccaccatcaccatg

*Homo sapiens* beaded filament structural protein 1, filensin
(BFSP1):

(Seq ID No: 94)

gcctcctttctttctcagcccagacctggccctctggagagggtttt
ggagtcctgggtaggcagggtacctcaggcagcaggcagcacacctt
ggatgtgagctgaatggattttcaaatttcacagaaggagcctccatgctgga
gaaagtatgtatg

*Homo sapiens* basic transcription factor 3 (BTF3):

(Seq ID No: 95)

cggcctcccttttagctgccatctt
gcgtccccgcgtgtgtgcgcctaatctcaggtggtccacccgagaccccttgagcac
caaccctagtcccccgcgcggccccttattcgctccgacaagatg

*Homo sapiens*
complement component 1, q subcomponent binding protein
(C1QBP):

(Seq ID No: 96)

ttgtcctttgcatctgcacgtgttcgcagtcgtttccgcgatg

*Homo sapiens* calsequestrin 1 (fast-twitch, skeletal muscle) (CASQ1):

(Seq ID No: 97)

tttcctttcttaatatggcgatgagctcttaggccagtgtggggac
cggggctgaggtgccctggacactggaggaggggagggaaggagcccctgg
gagcctggggtagaagtgtaggaggtggggaggattccggcccg
catggagctgtcctggcctcagaaggttatccgtctctcctgccaaccatggaga
catatttagacaggaccaggtggggactgagggtgccaatttcaggggg
cagctccggttccctccccgccccctgctcctattcctccacctgacccttttccctt
ggctctgtcggcagtttctccaggacccagcagtgccctctgtccac
tgctctgggccattcccaatcccccctcccacttgagcccctaactcagaatctgg
gacccaggggcccctccctaccccagctaacctcttctggaccagga
gagccaacccagatcccactacctccatg

*Homo sapiens* caveolin 3 (CAV3):

(Seq ID No: 98)

gtctctctgcccctctctgccccaagtattttcagcccagccggccacacagctcg
gatctcctcctgtggatcccccagctctgcgatg

*Homo sapiens* serpin peptidase inhibitor, clade H
(heat shock protein 47), member 1, (collagen
binding protein 1) (SERPINH1):

(Seq ID No: 99)

aggtctttggctttttttggcggagctggggcgccctccggaagcgtttccaactttcca
gaagtttctcgggacgggcaggaggggtggggactgccatatatagatcccgggagcag
gggagcgggctaagagtagaatcgtgtcgcggctcgagagcgagagtcacgtcccggcgc
tagcccagcccgacccaggccaccgtggtgcacgcaaaccacttcctggccatg

*Homo sapiens* CD68 molecule (CD68):

(Seq ID No: 100)

tttcctcctttccaaga
gagggctgagggagcagggttgagcaactggtgcagacagcctagctggacttt
gggtgaggcggttcagccatg

*Homo sapiens* cell division cycle 20 homolog (*S. cerevisiae*)
(CDC20):

(Seq ID No: 101)

gggtccctttctgtccctgagcac
cgtcgcctcctttcctccagggctccgtaggcaccaactg
caaggacccctcccctgcgggcgctcccatg

*Homo sapiens* cadherin 13, H-cadherin (heart) (CDH13):

(Seq ID No: 102)

gagcctctcctcaaagcctggctcccacgaaaatatgctcagtgcagccgcgtg
catgaatgaaaacgccgccgggcgcttctagtcggacaaaatg

*Homo sapiens* regulator of chromosome condensation
(RCC1) and BTB (POZ) domain containing protein 2 (RCBTB2):

(Seq ID No: 103)

cgctcccttcgtttccgtctcggccgggcacccgagcg
catcccgccgaggccgggccgtttcagggg
gaggcgccaactcatcgcggcgccgggcccctgaccgtgcagtaaccgctacccag
gaggcggagcggacaaggctccggcctgcgaggagtcacattaactttgctctagaaga
caacttacaaggatctaaaaggaacaggattaaagatgactgaa
tactgggttccagaaatttaaaacaatcagcttagcaaatcatatattcttctgtg
gagctgagaattgatgtccgctcttcccgtgatttggaacttccaatcccaga
gaaaagttgacaaagggactgcccaggactgagtccatatg

*Homo sapiens* cold inducible RNA binding protein (CIRBP):

(Seq ID No: 104)

ccccccctcactcgcgcgttaggaggctcgggtcgttgtggtgcgctgtcttcccgctt
gcgtcagggacctgcccgactcagtggccgccatg

*Homo sapiens* LIM domain binding 2 (LDB2):

(Seq ID No: 105)

cctcctctcctctccctctcctctcctgctatagagggctccgacagcag
ttcccagccagcgtgttcagcctgcctgcctgcctgcctctgtgtgtgtgtgagcgtgtg
tgcgtgcgtctactttgtactgggaagaacacagcccatgtgctctgcatggac
gttactgatactctgtttagcttgattttcgaaaagcaggcaagatg

*Homo sapiens* chloride channel, nucleotide-sensitive, 1A
(CLNS1A):

(Seq ID No: 106)

ctgcctcttccagggcgggcggtgtggtgcacgcatt
gctgtgctccaactccctcagggcctgtgttgccgcactctgctgctatg

*Homo sapiens* collapsin response mediator protein 1 (CRMP1):

(Seq ID No: 107)

cctcctcctctcccgccctcctcgccgatccgggcggtgctggcagccg
gagcggcggcgggcgggccgagcagccggggcagccgcgcgtgggcatccac -continued gggcgccgagcctccgtccgtgtctctatccctcccgggccttt
gtcagcgcccgctgggagcggggccgagagcgccggttccagtcagacagccccg
caggtcagcggccgggccgagggcgccagaggggccatg Homo sapiens catenin (cadherin-associated protein), delta 1
(CTNND1):

(Seq ID No: 108)

ttgcctttggctgggtgcaacttccattttaggtgttggatctgagggg
gaaaaaaagagagagggagagagagaaagaagagcaggaaagatcccgaaaggag
gaagaggtggcgaaaaatcaactgccctgctggatttgtctttctcagcacctt
ggcgaagccttgggtttctttcttaaaggactgattttttagaactccacatttt
gaggtgtgtggcttttgaagaaaatgtatgtactgacgggaaaaggaggataa
gcaagtcgaattttttgtcttacgctctctccttcctgcttcctcctt
gctgtggtggctgggatgcttcttccatgattttttgaatcta
gactgggctgttctctgtgttaaaccaatcagttgcgaccttctcttaacag
tgtgaagtgaggggtctctctccctccttctccttcctctgtgattcac
cttccttttaccctgccctgcggcggctccgccccttaccttcatg Homo sapiens diacylglycerol kinase, alpha 80 kDa (DGKA):

(Seq ID No: 109)

ccgtcccctccagcccagctcgggctccagctccagcgccggcgcttcagctgcgac
cgcgagccctctcaagcaagatataacttccccaagtcacacagtggtatcagagctaa
gaatgggacccagatatgactgatctagttctgttccaaaaccgtgctgtatta
tattaacgcctaccctctgaagaggtccaagcaacggaagtactactacgaa
gctgcctttctggccatccttgagaaaaatagacagatgagttcctgccagtgag
tcccctaggcctccatctctctcccttgctgtaccaccttccaccac
catccatgcgaccccaagagccttaatgactctagaagagactccaggcaggggaa
gctgaaaggacctttcactcccactttttggccagggccttctgtgccacctgccaa
gaccagcaggcctaccctctgaagaggtccaagcaacggaagtactactacgaa
gctgcctttctggccatccttgagaaaaatagacagatg Homo sapiens aspartyl-tRNA synthetase (DARS):

(Seq ID No: 110)

cgatctttctg
gagccgcacctccacgcggagtccgagcgcgtgtgctgagaccccagggtcgg
gagggcggagactgggaggagggagaagcccctttggcctgccttacgaaa
gcctgcgagggagggtggtgtccactgcccagttccgtgtcccgatg Homo sapiens dynein, cytoplasmic 1, intermediate chain 2
(DYNC1I2):

(Seq ID No: 111)

agttcttctcgatcgtgtcagtttgtaaggcgagggcggaagttggat
tcctggcctgagaatattaggcgtagttttccagttttttggcaaagcggaaa
tacttaaggcccctgggttgactgggttctttgttttatctaccggcttctgctttac
gacaggtcacaaacatg Homo sapiens dedicator of cytokinesis 1 (DOCK1):

(Seq ID No: 112)

tttcctccccatcctgtcgcggctcgaaaggaatggaaaatggcggcctagacgcggag
tttcctgcccgacccgcggcggctccggcggcgccatg Homo sapiens dihydropyrimidinase-like 2 (DPYSL2):

(Seq ID No: 113)

ctctctcttttttttccgccctagctggggctgtgttggaggagaggaagaaagagaga
cagaggattgcattcatccgttacgttcttgaaatttcctaatagcaagaccagcgaa
gcggttgcacccttttcaatctt
gcaaaggaaaaaaacaaaacaaaacaaaaaaacccaagtcccttcccggcagttttt
gccttaaagctgccctcttgaaattaattttttcccaggagagagatg Homo sapiens developmentally regulated GTP binding protein 2
(DRG2):

(Seq ID No: 114)

tgttctctttggcttccgggcgcacgctactctgtcgccgccgtcagaccg
gaattgccggtgccgccgccaccgctgtctgtgcgcccacctctgctgctaccatg Homo sapiens
eukaryotic translation elongation factor 1 alpha
1 (EEF1A1):

(Seq ID No: 115)

cgttcttttcgcaacgggttt
gccgccagaacacaggtgtcgtgaaaactaccctaaaagccaaatg

Homo sapiens
eukaryotic translation elongation factor 1 gamma
(EEF1G):

(Seq ID No: 116)

tctcctctttcccccctcccttctctcccgggcggcttactttgcgg
cagcgccgagaaccccaccccctttctttgcggaatcaccatg -continued

*Homo sapiens*
eukaryotic translation initiation factor 2, subunit
3 gamma, 52 kDa (EIF2S3):

(Seq ID No: 117)

atttccttcctcttttggcaacatggcgggc

*Homo sapiens* eukaryotic translation initiation factor 4B
(EIF4B):

(Seq ID No: 118)

gggtcttttgcgttctctttccctctcccaacatg

*Homo sapiens*
eukaryotic translation initiation factor 4 gamma,
2 (EIF4G2):

(Seq ID No: 119)

tattcttttgaagattcttcgttgtcaagccgccaaagtg

*Homo sapiens* epithelial membrane protein 1 (EMP1):

(Seq ID No: 120)

cttcccctcagtgcggtcacatacttccagaagagcggaccagggctgctgccagcac
ctgccactcagagcgcctctgtcgctgggacccttcagaactctcttt
gctcacaagttaccaaaaaaaaaagagccaacatg

*Homo sapiens* fibrillarin (FBL):

(Seq ID No: 121)

cgctcttttccacgtgcgaaagccccg
gactcgtggagttgtgaacgccgcggactccggagccgcacaaaccagggctcgccatg

*Homo sapiens* exostoses (multiple)-like 2 (EXTL2):

(Seq ID No: 122)

ctgtcccctt
gctccaggcgctcactttgcgggcggcacttttccaggttgttaatccagctaatgga
gaaggatagatgcacgctacttggtttagaaaaaaaaacaaaaatgagcaaacgagac
gcccccttccgttttatgataactaagctgcagggaaataaatcggctggccctactg
caatctactgcactcgagaaacatcacagaaaattctttgatttatcttaa
tagtgacaagtgagcctgcttctgtcaattactgaagctataaggagat
ttttttaaaaattaaacttcaacacaatg

*Homo sapiens* solute carrier family 37 (glucose-
6-phosphate transporter), member 4 (SLC37A4):

(Seq ID No: 123)

ccgcctctgttcaggacactgggtcccctggagcctccccaggcttaatgattgtccag
aaggcggctataaagggagcctgggaggctgggtggaggagggagcagaaaaaacccaac
tcagcagatctgggaactgtgagagcggcaagcaggaactgtggtcagaggctgtgcgtc
ttggctggtagggcctgctcttttctaccatg

*Homo sapiens* GDP dissociation inhibitor 2 (GDI2):

(Seq ID No: 124)

agccctcccctcctcgctccctcccctcctctccccgcccag
ttcttctcttcccgtctgaggtggcggtcggtctcgccttt
gtcgccagctccatttcctctctttctcttccccttttccttcgcgcccaa
gagcgcctcccagcctcgtagggtggtcacggagcccctgcgccttttcctt
gctcgggtcctgcgtccgcgcctgccccgccatg

*Homo sapiens*
UDP-Gal:betaGlcNAc beta 1,4-galactosyltransferase,
polypeptide 1 (B4GALT1):

(Seq ID No: 125)

caccccttcttaaagcggcggcgggaagatg

*Homo sapiens* GDP-mannose 4,6-dehydratase (GMDS):

(Seq ID No: 126)

ggccctccctgcac
ggcctcccgtgcgcccctgtcagactgtggcggccggtcgcgcggtgcgctctccctccc
tgcccgcagcctggagaggcgcttcgtgctgcacacccccgcgttcctgccggcac
cgcgcctgccctctgccgcgctccgccctgccgccgaccgcacgcccgccgcgggacatg

*Homo sapiens* histone deacetylase 2 (HDAC2):

(Seq ID No: 127)

ggcccctcctcgcgagttggtgccgctgccacctccgattccgagctttcggcac
ctctgccgggtggtaccgagccttcccggcgcccctcctctcctcccac
cggcctgcccttccccgcgggactatcgcccccac
gtttccctcagcccttttctctcccggccgagccgcggcggcagcagcagcagcagcag
cagcaggaggaggagcccggtggcggcggtggccggggagcccatg

*Homo sapiens* protein arginine methyltransferase 2 (PRMT):

(Seq ID No: 128)

gggccttcccggctgacggcctgcgtgcactgcgcttgcgcgggtt
gagggcggtggctcaggctcctggaaaggaccgtccaccccctccgcgctggcggtgtg
gacgcggaactcagcggagaaacgcgattgagagcagtgtgtggattacactatcactg -continued
gaaaaatacgaattgagaagaaggaaaagactggaagatgcagacctt
ggttcctgttagtggaaacactgtaaggtcccagaaatggaaaagaaaatgaaa
taaatcagcagttatgaggcagagcctaagagaactatg Homo sapiens immunoglobulin (CD79A) binding protein 1
(IGBP1):

(Seq ID No: 129)

gttcctctctccccaagatg

Homo sapiens
eukaryotic translation initiation factor 3, subunit
E (EIF3E):

(Seq ID No: 130)

actccctttctcttggcaagatg

Homo sapiens activated leukocyte cell adhesion molecule (AL-
CAM):

(Seq ID No: 131)

gtccctctactcagagcagcccggagaccgctgccgccgctgccgctgctaccaccgctg
ccacctgaggagacccgccgcccccccgtcgccgcctcctgcgagtccttcttagcacct
ggcgtttcatgcacattgccactgccattattattatcattccaatacaaggaaaataaa
agaagataccagcgaaaagaaccgcttacaccttccgaattactcaagtgtctcctgga
aacagagggtcgttgtcccggaggagcagccgaagggcccgtgggctggtgttgaccgg
gagggaggaggagtgggggcattgcgtggtggaaagttgcgtgcggcagagaaccgaag
gtgcagcgccacagcccaggggacggtgtgtctgggagaagacgctgcccctgcgtcggg
acccgccagcgcgcgggcaccgcggggcccgggacgacgccccctcctgcggcgtggact
ccgtcagtggcccaccaagaaggaggaggaatatg Homo sapiens acyloxyacyl hydrolase (neutrophil) (AOAH):

(Seq ID No: 132)

ttttctttatcctgcagtctttacctcagcagaaccgcacac
cacagactccctccagctctttgtgtgtggctctctcagggtccaacaagagcaa
gctgtgggtctgtgagtgtttatgtgtgcttttattcacttcacac
ttattgaaaagtgtgtatgtgagagggtggggtgtgtgtcaaagagagtgaggaaga
gaaggagagagagatcaattgattctgcagcctcagctccagcatccctcagttgg
gagcttccaaagccgggtgatcacttggggtgcatagctcggagatg Homo sapiens ADP-ribosylation factor 1 (ARF1):

(Seq ID No: 133)

ccgccccttacccggcgtgccccgcgcccggaggcgctgac
gtggccgccgtcagagccgccatcttgtgggagcaaaaccaacgcctggctcggagcag
cagcctctgaggtgtccctggccagtgtccttccacctgtccacaagcatg Homo sapiens ADP-ribosylation factor 6 (ARF6):

(Seq ID No: 134)

gcgccttttccggcagcggcggcggcagaactggaggaggagttggaggccg
gagggagcccgcgctcggggcggcggctggaggcagcgcaccgagttcccgcgag
gatccatgacctgacggggcccg
gagccgcgctgcctctcgggtgtcctgggtcggtggggagcccagtgctcg
caggccggcgggcgggccgagggctgcagtctccctcgcggtgagaggaaggcggag
gagcgggaaccgcggcggcgctcgcgcggcgcctgcggggggaagggcag
ttccgggccgggccgcgcctcagcagggcggcggctcccagcgcag
tctcagggcccgggtggcggcggcgactggagaaatcaagtt
gtgcggtcggtgatgcccgagtgagcggggggcctgggcctctgcccttag
gaggcaactcccacgcaggccgcaaaggcgctctcgcggccga
gaggcttcgtttcggtttcgcggcggcggcggcgttgttggctgaggggacccgg
gacacctgaatgccccggccccggctcctccgacgcgatg Homo sapiens ras homolog family member A (RHOA):

(Seq ID No: 135)

cgccctcccgccgccgcccgccctcgctctctcgcgc
taccctcccgccgcccgcggtcctccgtcggttctctcgttagtccac
ggtctggtcttcagctacccgccttcgtctccgagtttgcgactcgcggac
cggcgtcccggcgcgaagaggctggactcggattcgttgcctgagcaatg Homo sapiens ras homolog family member G (RHOG):

(Seq ID No: 136)

cggcctcccgctctcacttccttctcgagcccggagccgctgccgccgcccccagctccc
ccgcctcggggagggcaccaggtcactgcagccagagggtccagaagagaggaggca
ctgcctccactacagcaactgcacccacgatg Homo sapiens
ATP synthase, H+ transporting, mitochondrial F1 complex,
O subunit (ATP5O):

(Seq ID No: 137)

ctctcttcccactcgggttttgaccta
cagccgcccgggagaagatg

-continued

*Homo sapiens* B lymphoid tyrosine kinase (BLK):

(Seq ID No: 138)

ccac
ctctgtctgctgccggcagaaagccacaagccatgaaaactgattgagatgagaa
gaattcatctgggactggcttttgctttaggatggtgttggaagttgctcgtt
gtcgctaggagcctgctccactgtaagggtgtcaggatctgaagagc
tatggtgaaacaccactgaagcattgccaaggatg

*Homo sapiens* B-cell translocation gene 1, anti-proliferative (BTG1):

(Seq ID No: 139)

gcatctcttcgcctctcggagctggaaatgcagctattga
gatcttcgaatgctgcggagctggaggcggaggcagctgggaggtccgagcgatgtgac
caggccgccatcgctcgtctcttcctctctcctgccgcctcctgtctcgaaaa
taactttttagtctaaagaaagaaagacaaaagtagtcgtccgcccctcac
gccctctcttcctctcagcttccgcccggtgaggaa
gcccggggtggctgctccgccgtcgggccgcgccgccgagcccagccgccccgggccg
ccccgcacgccgccccatg

*Homo sapiens* calcium modulating ligand (CAMLG):

(Seq ID No: 140)

cggcctctag
tcatcgccctcgcagcggcggccaacatcaccgccactgccacccctcccagactgtg
gacgggaggatg

*Homo sapiens* calnexin (CANX):

(Seq ID No: 141)

aggcctcttggttctgcggcacgtgac
ggtcgggccgcctccgcctctctctttactgcggcgcggggcaaggtgtgcgggcgg
gaaggggcacgggcaccccgcggtccccgggaggctagagatcatg

*Homo sapiens* calpain 2, (m/II) large subunit (CAPN2):

(Seq ID No: 142)

cgac
ctttctctgcgcagtacggccgccgggaccgcagcatg

*Homo sapiens* caveolin 1, caveolae protein, 22 kDa (CAV1):

(Seq ID No: 143)

gcgcctttttttccccccatacaatacaagatcttcctcctcagttcccttaaa
gcacagcccagggaaacctcctcacagttttcatccagccacgggccagcatg

*Homo sapiens* CD1d molecule (CD1D):

(Seq ID No: 144)

cgacctctttgcagctcg
cacagctaagggcgagggcgcccttcggcagaagcagcaaaccgccggcaa
gcccagcgaggagggctgccggggtctgggcttgggaattggctggcacccagcg
gaaagggacgtgagctgagcgcggggagaagagtgcgcaggtcagagggcggcgcg
cagcggcgctccgcgaggtccccacgccgggcgatatg

*Homo sapiens* CD22 molecule (CD22):

(Seq ID No: 145)

tctcctttt
gctctcagatgctgccagggtccctgaagagggaagacacgcggaaacaggctt
gcacccagacacgacaccatg

*Homo sapiens* CD37 molecule (CD37):

(Seq ID No: 146)

cttcctcttt
ggggttcttcctttctctctcagctctccgtctctctttctctctcagcctctttcttc
tccctgtctcccccactgtcagcacctcttctgtgtggtgagtggaccgcttacccac
taggtgaagatg

*Homo sapiens* CD38 molecule (CD38):

(Seq ID No: 147)

gcctctctctt
gctgcctagcctcctgccggcctcatcttcgcccagccaaccccgcctggagccctatg

*Homo sapiens* CD48 molecule (CD48):

(Seq ID No: 148)

cggccttttctagccaggctctcaactgtctcctgcgttgctgggaagttctg
gaaggaagcatg

*Homo sapiens* chromogranin B (secretogranin 1) (CHGB):

(Seq ID No: 149)

cttcctttccgcacaggggccgccgagcggggccatg

*Homo sapiens* chloride channel, voltage-sensitive 3 (CLCN3):

(Seq ID No: 150)

ttcccccttccgtgggtcagggccggtccggtccggaacctgcagccccttccccag
tgttctagttcgcccgtgacccggaataatgagcaaggagggtgtggtgggttgaaa -continued

```
gccatcctactttactcccgagttagagcatggattcagttttagtcttaagggg
gaagtgagattggagattttttattttttaattttgggcagaagcaggtt
gactctagggatctccagagcgagaggatttaacttcatgttgctcccgtgttt
gaaggaggacaataaaagtcccaccgggcaaaattttcgtaacctctgcggtagaaaac
gtcaggtatcttttaaatcgcgatagttttcgctgtgtcaggctttcttcggtg
gagctccgagggtagctaggttctaggtttgaaacagatgcagaatccaaaggcagcg
caaaaaacagccaccgattttgctatgtctctgagctgcgagataatcagacagc
taaatg
```

Homo sapiens colipase, pancreatic (CLPS):

(Seq ID No: 151)
```
ttccccttccgtgggtcagggccggtccggtccggaacctgcagccccttttcccag
tgttctagttcgcccgtgacccggaataatgagcaaggagggtgtggtgggttgaaa
gccatcctactttactcccgagttagagcatggattcagttttagtcttaagggg
gaagtgagattggagattttttattttttaattttgggcagaagcaggtt
gactctagggatctccagagcgagaggatttaacttcatgttgctcccgtgttt
gaaggaggacaataaaagtcccaccgggcaaaattttcgtaacctctgcggtagaaaac
gtcaggtatcttttaaatcgcgatagttttcgctgtgtcaggctttcttcggtg
gagctccgagggtagctaggttctaggtttgaaacagatgcagaatccaaaggcagcg
caaaaaacagccaccgattttgctatgtctctgagctgcgagataatcagacagc
taaatg
```

Homo sapiens cytochrome c oxidase subunit IV isoform 1 (COX4I1):

(Seq ID No: 152)
```
ctaccctttccgctccacggtgacctccgtgcggccgggtgcgggcg
gagtcttcctcgatcccgtggtgctccgcggcgcggccttgctctcttccggtcgcgg
gacaccgggtgtagagggcggtcgcggcgggcagtggcggcagaatg
```

Homo sapiens cytochrome c oxidase subunit VIIc (COX7C):

(Seq ID No: 153)
```
cttctttcagtccttgcgcaccggggaacaaggtcgtgaaaaaaaaggtcttggtgag
gtgccgccatttcatctgtcctcattctctgcgccttcgcagagcttccagcagcgg
tatg
```

Homo sapiens activating transcription factor 2 (ATF2):

(Seq ID No: 154)
```
cagccttttcctccaggggtgctttgtaaacacggctgtgctcagggctcgcgggtgac
cgaaaggatcatgaactagtgacctggaaagggtactagatggaaacttga
gaaaggactgcttattgataacagctaaggtattcctggaagcagagtaaataaa
gctcatggcccaccagctagaaagtattcttgccatgagaaaagaatgtga
taagttattcaacttatg
```

Homo sapiens casein kinase 1, alpha 1 (CSNK1A1):

(Seq ID No: 155)
```
agatcccttcccagagtgctctgcgccgtgaagaagcggctcccggggactggggg
cattttgtgttggctggagctggagtaacaagatggcgtcgtccgcggag
tgacaggggtccctctgggccggagccggcggcagtggtggcagcgg
tatcgccgccctagctcaccgcgccccttttccagcccgcgacgtcgccgcgcaa
gcgaggcagcggcggccgccgagaaacaagtggcccagcctggtaaccgccgagaa
gccccttcacaaactgcggcctggcaaaaagaaac
ctgactgagcggcggtgatcaggttcccctctgctgattctgggccccgaacccgg
taaaggcctccgtgttccgtttcctgccgcctcctccgtagccttgcctagtgtag
gagccccgaggcctccgtcctcttcccagaggtgtcgggcctt
ggccccagcctccatcttcgtctctcaggatg
```

Homo sapiens catenin (cadherin-associated protein), beta 1, 88 kDa (CTNNB1):

(Seq ID No: 156)
```
aa
gcctctcggtctgtggcagcagcgttggcccggccccgggagcggagagcgaggg
gaggcggagacggaggaaggtctgaggagcagcttcagtccccgccgagccgccaccg
caggtcgaggacggtcggactcccgcggcgggaggagcctgttcccctgagggtattt
gaagtataccatacaactgttttgaaaatccagcgtggacaatg
```

Homo sapiens dCMP deaminase (DCTD):

(Seq ID No: 157)
```
ccgcctcctcccccgacttccttccctgagcacggcggcggcggggacgagcac
cggcctgcgcgcggagccggcaccggatgacccaacatg
```

Homo sapiens damage-specific DNA binding protein 1, 127 kDa (DDB1):

(Seq ID No: 158)
```
ctgtcttttcgcttgtgtccctctttctagtgtcgcgctcgagtcccgac
gggccgctccaagcctcgacatg
```

Homo sapiens desmin (DES):

(Seq ID No: 159)
```
ctgtctcccctcgccgcatccac
tctccggccggccgcctgcccgccgcctcctccgtgcgcccgccagcctcgcccgcgccg
tcaccatg
```

-continued

*Homo sapiens* deoxyhypusine synthase (DHPS):

(Seq ID No: 160)

cgttccctacttcctgtgctcttgcggagacgcgcgcgtcggggtttaac
gcgtttctgggccgccgtaagcccggcctaggggcagctttgactcgagagccggc
tataggcgcatg

*Homo sapiens* dihydrolipoamide S-acetyltransferase (DLAT):

(Seq ID No: 161)

caccctttcggatgcctcccctagaaccctaccactttccaccccttccgtctgttatt
tctcccaaacttgcgcccgcacaggcccctctggaacactcctgccccgtagtgcccctc
gtccccgctccgtagagaaagagcgtgcgtgccgcgcatttctggctggggagcgggtg
gagtaaacctgcgggaaccattttacgacaacgtgcggctgtgcggtgtggctgacggca
acgccgctgctcttggagaggtcactccggagacggcgttggttttggggtgtgggggt
tggtggcactatg

*Homo sapiens* down-regulator of transcription 1, TBP-binding
(negative cofactor 2) (DR1):

(Seq ID No: 162)

ccttccctggcatctggagggaccaccgtt
gccgcgtcttcggcttccacgatctgcgttcgggctacgcggccacggcggcagccac
tgcgactcccactgtgcctggctctgtccatattag
ttcccaggcggccgtcgccgttccagcagcggcagcggcagcggcagcggcg
gacatgttgtgaggcggcggcgcgggtgtctgaaggatggtttggccgaggcggcgg
caacggctgctggcggcggcggcagcggcagcggggcctcgggctctata
gagccgagcccgctgggtacccgcccggtaccgcggcgaggccagtgccctggatctt
gcctctgctccgacgccgttggggaccagttaggcgacagcgcccgccctctgag
gagacacgaaggtggttccccagccgctcaaatttccggaccac
cgcgctttcccctcctcagcctgggctgtgctctctctagaatcctcgggccccac
tttcttcccaaactcatcctaaatctctcacacacgcgagtgttcccagccctcaa
gccagctgctcctccgttcattttctgcaccctcttcgcaaagcaccccccgggatcac
tctccgagggcgacttttttgagaaatctcggtggagtagtggaccagagctggggag
ttttttaaaagccggggcgcgagaaacaggaaggtactatg

*Homo sapiens* endothelin receptor type A (EDNRA):

(Seq ID No: 163)

ttttcttttcgtgcgagccctcgcgcgcgcgtacagtcatcccgctggtctgac
gattgtggagaggcggtggagaggcttcatccatcccacccggtcgtcgccggg
gattgggtcccagcgagaacctccccgggagaagcagtgccaggaggttttctgaa
gccggggaagctgtgcagccgaagccgccgccgcgccggagcccgggacac
cggccaccctccgcgccacccaccctcgccggctccggcttcctctggcccaggcgccgc
gcggacccggcagctgtctgcgcacgccgagctccacggtgaaaaaaaagtgaaggtg
taaaagcagcacaagtgcaataagagatatttcctcaaatttgcctcaagatg

*Homo sapiens*
eukaryotic translation elongation factor 1 alpha
2 (EEF1A2):

(Seq ID No: 164)

cagtccctctggctgagacctcggctccggaatcactg
cagccccctcgccctgagccagagcaccccgggtcccgccagcccctcacactcccag
caaaatg

*Homo sapiens* eukaryotic translation elongation factor 2
(EEF2):

(Seq ID No: 165)

cgttctcttccgccgtcgtcgccgccatcctcggcgcgactcgcttctttcggttctac
ctgggagaatccaccgccatccgccaccatg

*Homo sapiens* eukaryotic translation initiation factor 4A2
(EIF4A2):

(Seq ID No: 166)

ctgtcttttcagtcgggcgctgagtggttttttcggatcatg

*Homo sapiens* egf-like module containing, mucin-like, hormone
receptor-like 1 (EMR):

(Seq ID No: 167)

gtttcttttctttgaatgacagaactacag
cataatg

*Homo sapiens* enolase 2 (gamma, neuronal) (ENO2):

(Seq ID No: 168)

gcgcctcctccgcccgccgcccgggagccgcagccgccgccgccactgccac
tcccgctctctcagcgccgccgtcgccaccgccaccgccaccgccactaccac
cgtctgagtctgcagtcccgagatcccagccatcatg

*Homo sapiens* esterase D (ESD):

(Seq ID No: 169)

ccgccttttacttcggcccgcttcttctggtcactccgccaccgtagaatcgcctac
catttggtgcaagcaaaaagcaatcagcaattggacaggaaaagaatg -continued

*Homo sapiens* Finkel-Biskis-Reilly murine sarcoma virus
(FBR-MuSV) ubiquitously expressed (FAU):

(Seq ID No: 170)

cttcctctttctcgactccatcttcgcggtagctgggaccgccgttcagtcgccaatatg

*Homo sapiens* Friend leukemia virus integration 1 (FLI1):

(Seq ID No: 171)

ctgtctctttcgctccgctacaacaacaaacgtgcacaggggagtgaggg
cagggcgctcgcaggggcac
gcagggagggcccagggcgccaggggaggccgcgccgggctaatccgaaggggctgcgagg
tcaggctgtaaccgggtcaatgtgtggaatattgggggctcggctgcagacttggc
caaatg

*Homo sapiens* fibromodulin (FMOD):

(Seq ID No: 172)

gccccttttcacaatatttgattag
gaatttggggcgggaccctggtctggcacaggcacgcacactctcag
tagactcttcactcctctctctcttcctctctcacac
gttctccaacccaaggaggccagacagagggacgtggtcac
tctctgaaaagttcaacttgagagacaaaatg

*Homo sapiens* ferritin, heavy polypeptide 1 (FTH1):

(Seq ID No: 173)

cgttcttcgccgagagtcgtcggggtttcctgcttcaacagtgcttggac
ggaaccggcgcgctcgttcccaccccggccggccgcccatagccagccctccgtcac
ctcttcaccgcaccctcggactgcccaaggcccccgccgcgctccagcgccgcg
cagccaccgccgccgccgccgcctctccttagtcgccgccatg

*Homo sapiens* glyceraldehyde-3-phosphate dehydrogenase
(GAPDH):

(Seq ID No: 174)

cgctctctgctcctcctgttcgacagtcagccgcatcttcttt
gcgtcgccagccgagccacatcgctcagacaccatg

*Homo sapiens* glycyl-tRNA synthetase (GARS):

(Seq ID No: 175)

caccctctctg
gacagcccagggccgcaggctcatg

*Homo sapiens* glutamic-oxaloacetic transaminase 2, mitochondrial
(aspartate aminotransferase 2) (GOT2):

(Seq ID No: 176)

ctgtccttaccttcagcaggagccggttccctgtgtgtgtgtccgctcgccctctgctcc
gtcctgcggctgcccactgccctcctacggtccaccatg

*Homo sapiens*
general transcription factor IIF, polypeptide 1,
74 kDa (GTF2F1):

(Seq ID No: 177)

gcgcctcttccggttac
cttttcccagcgccagaggcgcctagggttggggtcctcgctcaggcacaga
gacccgacaccgagcggcggcttccccgggatcgagggacgcgcacgccagaggagac
gaaaggaacccgggtcggaccagatcggaaccactgaccattgcccatg

*Homo sapiens* glycogen synthase 1 (muscle) (GYS1):

(Seq ID No: 178)

cggcctccttctgcctaggtcccaacgcttcggggcaggggtgcggtcttgcaa
taggaagccgagcgtcttgcaagcttcccgtcgggcaccagctactcggccccg
caccctacctggtgcattccctagacacctccgggggtccctacctggagatccccg
gagccccccttcctgcgccagccatg

*Homo sapiens* major histocompatibility complex, class I, C
(HLA-C):

(Seq ID No: 179)

cattctccccagaggccgagatg

*Homo sapiens*
major histocompatibility complex, class II, DP beta
1 (HLA-DPB1):

(Seq ID No: 180)

gctcccttagcgagtccttctttctgactg
cagctctttcattttgccatccttttccagctccatg

*Homo sapiens* 3-hydroxy-3-methylglutaryl-CoA synthase 1 (soluble)
(HMGCS1):

(Seq ID No: 181)

ctgtcctttcgtggctcac
tcccttcctctgctgccgctcggtcacgcttgctctttcaccatg

*Homo sapiens* hippocalcin (HPCA):

(Seq ID No: 182)

ccgccttccctgcgcag
tcggtgtctccgcgtcgctgggtgggacttggctcggcggccatg

*Homo sapiens* hydroxysteroid (17-beta) dehydrogenase 2 (HSD17B2):

(Seq ID No: 183)

ctcccttctt
gactctctgttcacagaactcaggctgcctccagccagccttttgcccgctagactcac
tggccctgagcacttgaaggtgcagcaagtcactgagaatg

*Homo sapiens* heat shock 60 kDa protein 1 (chaperonin) (HSPD1):

(Seq ID No: 184)

ctgtccctcactcgccgccgacgacctgtctcgccgagcgcacgcctt
gccgccgccccgcagaaatg

*Homo sapiens* intercellular adhesion molecule 3 (ICAM3):

(Seq ID No: 185)

ccgccttttcccctgcctgcccttcgggcacctcaggaaggcaccttcctctgtca
gaatg

*Homo sapiens* inositol polyphosphate-1-phosphatase (INPP1):

(Seq ID No: 186)

cgtcctctggccgcgcctgcggccgcacgcccagcgcccctcgcctaacctcgcgcccgg
gccgcgcctcctcctcctcctgctccccgccgcttccgtttctcgagggaaaggctgctg
cctcctgctctgtcctcatccccggcttagctgacggcccagagggtgggtgccaattcc
accagcagctgcaactgaaaagcaaggttcagaaatg

*Homo sapiens* interferon regulatory factor 2 (IRF2):

(Seq ID No: 187)

gtttcctctccttgttttgctttcgatctggactgttctcaggcaagccggggag
taacttttagttttgctcctgcgattattcaactgac
gggctttcatttccatttcacatacccctagcaacacttataccttgcggaatt
gtattggtagcgtgaaaaaagcacactgagagggcaccatg

*Homo sapiens* inter-alpha-trypsin inhibitor heavy chain 2 (ITIH2):

(Seq ID No: 188)

ttttcttcttttttcttctttcttaaagcgaactg
tactcctctgctgttcctttgaacttggttcagtaggaagaagtga
tatcctcccagaccatctgctttggggagcttggcaaaactgtccagcaaaatg

*Homo sapiens* karyopherin (importin) beta 1 (KPNB1):

(Seq ID No: 189)

ccgccttcctccctccctcgctccctccctgcgcgccgcctctcac
tcacagcctcccttcctctttctccctccgcctcccgagcac
cagcgcgctctgagctgcccccagggtccctccccgccgccagcagccattt
ggagggaggaagtaagggaagaggagaggaagggagccggaccgactacccaga
cagagccggtgaatgggttt
gtggtgaccccgccccaccccaccctcccttcccacccgaccccaaccccatccc
cagttcgagccgccgccgaaaggccgggccgtcgtcttaggaggag
tcgccgccgccgccacctccgccatg

*Homo sapiens* karyopherin alpha 3 (importin alpha 4) (KPNA3):

(Seq ID No: 190)

ctctccccctcctcccctcccgctccaagattcgccgccgccgccgccgcagccgcag
gagtagccgccgccggagccgcgcgcagccatg

*Homo sapiens* keratin 19 (KRT19):

(Seq ID No: 191)

gctcctcccgcgaatcg
cagcttctgagaccagggttgctccgtccgtgctccgcctcgccatg

*Homo sapiens* laminin, beta 1 (LAMB1):

(Seq ID No: 192)

attcccttcttt
gggctcggggctcccggagcagggcgagagctcgcgtcgccggaaaggaagacgggaa
gaaagggcaggcggctcggcgggcgtcttctccactcctctgccgcgtccccgtggctg
cagggagccggcatg

*Homo sapiens* ribosomal protein SA (RPSA):

(Seq ID No: 193)

ctgtcttttccgtgc
tacctgcagagggtccatacggcgttgttctggattcccgtcg
taacttaaagggaaattttcacaatg

*Homo sapiens* lymphocyte cytosolic protein 1 (L-plastin) (LCP1):

(Seq ID No: 194)

ttttctttcctggctgatgatttgtcattctagtcacttcctgcctt
gtgaccacacaccaggcttgacaaagctgttctgcagatcagaaa
gaagggttcctggtcataccagtactaccaaggacagctttttcctgcaa
gatctgttacctaaagcaataaaaaatg

*Homo sapiens* lectin, galactoside-binding, soluble, 1 (LGALS1):

(Seq ID No: 195)

ccatctctctcggtggagtcttctgacagctggtgcgcctgcccgggaacatcctcctg
gactcaatcatg

*Homo sapiens* SH2 domain containing 1A (SH2D1A):

(Seq ID No: 196)

ttctctcttttttgcacatctggctgaactgggagtcaggtggttgactt
gtgcctggctgcagtagcagcggcatctcccttgcacag
ttctcctcctcggcctgcccaagagtccaccaggccatg

*Homo sapiens* mannosidase, alpha, class 2A, member 1 (MAN2A1):

(Seq ID No: 197)

tgttcctttcccctccgcttctctgac
ctagctgcgcggccccggcccgggagctgccgaacccgcgcctcccctgggtgaggag
gacacgcctgccctcgtcgagaaaacttttcctgccgactcagttggggcggcggtgg
caggaagtgcgggcagcgacctctcctccgcctgccccgcgcgcctgccg
gaggtcggcgctgagcttgcgatcaagtttgtgggggccccccttcccagtt
gccggcgagtctcgcctcgagaggggcgcccgaccccggggagggcgg
caggccagggcgaaggccaagggcgtgtggtggcgccggagactaggtgcggag
caaggcggggactcgcacccgcatccgagagcgcggaggtcgcgcagcccggga
gaagggagcctccggcggctgcttcctagagtccacagtgcgctgtctcctttt
ggctgaggagagtgtcctggccccgagtctatcgaggaaaatg

*Homo sapiens* myelin basic protein (MBP):

(Seq ID No: 198)

ccgcctcttttcccga
gatgccccggggagggaggacaacaccttcaaagacaggccctctgagtccgac
gagctccagaccatccaagaagacagtgcagccacctccgagagcctggatgtgatg

*Homo sapiens* melanocortin 1 receptor (alpha melanocyte stimulating hormone receptor) (MC1R):

(Seq ID No: 199)

cattcttcccaggacctcagcgcagccctggcccaggaaggcaggagacagaggccag
gacggtccagaggtgtcgaaatgtcctggggacctgagcagcagccaccagggaa
gaggcagggaggggagctgaggaccaggcttggttgtgagaatccctgagcccaggcgg
tagatgccaggaggtgtctggactggctgggccatgcctgggctgac
ctgtccagccagggagagggtgtgaggg
cagatctgggggtgcccagatggaaggaggcaggcatgggg
gacacccaaggcccctggcagcaccatgaactaagcaggacacctggagggaa
gaactgtggggacctggaggcctccaacgactccttcctgcttcctggacaggactatg

*Homo sapiens* malic enzyme 1, NADP(+)-dependent, cytosolic (ME1):

(Seq ID No: 200)

gggcctttcccagtgcggccgccgccgccacagctgcagtcagcac
cgtcaccccagcagcatccgccgcctgcac
cgcgcgtgcggcccgccccggcctgaccccgccgccgaacccggcgccagccatg

*Homo sapiens* myocyte enhancer factor 2C (MEF2C):

(Seq ID No: 201)

agctctctgctcgctctgctcgcagtcacagacacttgagcacacgcgtacacccagaca
tcttcgggctgctattggattgactttgaaggttctgtgtgggtcgcgtggctgcatgt
ttgaatcaggtggagaagcacttcaacgctggacgaagtaaagattattgttgttatttt
ttttttctctctctctctcttaagaaaggaaaatatcccaaggactaatctgatcggg
tcttccttcatcaggaacgaatgcaggaatttgggaactgagctgtgcaagtgctgaaga
aggagatttgtttggaggaaacaggaaagagaaagaaaaggaaggaaaaaatacataatt
tcagggacgagagagagaagaaaaacgggactatg

*Homo sapiens* mannosyl (alpha-1,3-)-glycoprotein beta-1,2-N-acetylglucosaminyltransferase (MGAT1):

(Seq ID No: 202)

agcccttcttggggaagtcagctacccagcagcctgtag
tcctcggctacccaccctcaccgcctggggtcccatggtgagacagctgggtggg
catcaggcttctgcagaggggccaggccggagggagctgggcgagggag
tggggctggctcctggcttgcaccggcctcgtggaatccaggcctcagac
ctgatcgctggcgaaactggctctgtgcgctg
gagcccctggtcttctgcgtctgtcctcctcccggccagactttactcctggctcagcga
caggtatttgctatggaagagctgtccctccctccccctcggtgggcctgggtccac -continued ctccacctcctcttcaggtccgcaccttcctccccttaaaacaccagccgggcg
cagaccgttctaggcttttccatggtgcttccgccaaagcttgtgaccgag
tccttcccgcctagggctggtgggcctccctgctgg
taggtctctcttcgctttctttactcagaactgaagctctcattccccacccac
caaggaaaaacaaaagggaagaagccacagctggccccggcttgctttgg
cacaggtgtttccccccggcccccgtcggg
caccctggttcctgttctgtccctgcccac
gcgaccctgggctcccacccgggctcctcagcctccctgggttggggtggggg
gactggctccagcccttggcctaggtttggtgaacgccttcctg
gactgcgggcccacttcaggcgcggctccaggctgggcagctgcgctg
gagggccgaggcaggggtggggtcgggcgtccaccctcagggttgcgccagggagccg
gaaagccgactcccgaagttggggtcctgggaaaacttgggtcctgggttgactgagaa
gcggcgggaaaggaggcgggccaggaggaggggcctggcggac
gccggcggggggcggggcgcggcggggctgtcggtcacgcccctcag
tccgccccgccccgcccgcctgccggggaagggccacgtt
gcccgccggccgtccggcccggcgcgccgcagaaagggctggcgag
tcgaaaggcgaggcggccgcggcagcgcttgggacgcgcctgggcac
cgggctcgctccctgcgccccggagcaggccaagttcggggccaggacgtcggggaggac
ctggtgcatggctgcctcctaatcccatagtccagaggaggcatccctaggactgcggg
caagggagccgggcaagccagggcagccttgaac
cgtcccctggcctgccctcccggtggggccaggatg

*Homo sapiens*
mitogen-activated protein kinase kinase kinase 11
(MAP3K11):

(Seq ID No: 203)

ctgcctcccgccccggggccaaagtacaaagggaggaggaa
gaagggagcggggtcggagccgtcggggccaaaggagacggggccaggaacaggcag
tctcggcccaactgcggacgctccctccaccccctgcgcaaaaagacccaaccggagtt
gaggcgctgccctgaaggccccaccttacacttggcggggggccg
gagccaggctcccaggactgctccagaaccgagggaagctcgggtccctccaa
gctagccatggtgaggcgcggaggccccggggccccaccccccggcctgaccacac
tgccctgggtgcctcctcagaagcccgagatgcgggggggccgggagacaacac
tcctggctcccagagaggcgtgggtctggggctgagggccagggcccg
gatgcccaggttccgggactagggcctggcagccagcgggggtggggaccacggg
cacccagagaaggtcctccacacatcccagcgccggctcccggccatg

*Homo sapiens* membrane protein, palmitoylated 1, 55 kDa
(MPP1):

(Seq ID No: 204)

ccgccttctccgcagccccgcaggccccgggccctgtcattcccagcgctgccctgtctt
gcgttccagtgttccagcttctgcgagatg

*Homo sapiens* v-myc myelocytomatosis viral oncogene homolog
(avian) (MYC):

(Seq ID No: 205)

ggccctttataatgcgagggtctggacggctgag
gaccccgagctgtgctgctcgcggccgccac
cgccgggccccggccgtccctggctccctcctgcctcgagaaggg
cagggcttctcagaggcttggcgggaaaaagaacggagggagggatcgcgctgag
tataaaagccggttttcggggcttatctaactgctgtagtaattccagcga
gaggcagagggagcgagcgggcggccggctaggtggaagagccgggcgag
cagagctgcgctgcgggcgtcctgggaagggagatccggagcgaa
tagggggcttcgcctctggcccagccctcccgctgatccccagccagcggtccg
caaccctcgccgcatccacgaaactttgcccatagcagcgggcgggcactttgcactg
gaacttacaacacccgagcaaggacgcgactctcccgacgcggggaggc
tattctgcccatttggggacacttccccgccgctgccag
gacccgcttctctgaaaggctctccttgcagctgcttagacgctg

*Homo sapiens* nuclear cap binding protein subunit 1, 80 kDa
(NCBP1):

(Seq ID No: 206)

tggcctctcggttccgcggcgcaccggagggcagcatg

*Homo sapiens* necdin homolog (mouse) (NDN):

(Seq ID No: 207)

cttcctctccag
gaatccgcggagggagcgcaggctcgaagagctcctggacgcagaggccctgcccctt
gccagacggcgcagacatg

*Homo sapiens* NADH dehydrogenase (ubiqui-
none) 1 beta subcomplex, 5, 16 kDa (NDUFB5):

(Seq ID No: 208)

ccttcttcctcctgcccgtagtagccatg

*Homo sapiens* NADH dehydrogenase (ubiqui-
none) Fe-S protein 4, 18 kDa (NADH-coenzyme Q reductase)
(NDUFS4):

(Seq ID No: 209)

ccgtcctttcatcctggcgtttgcctgcagcaagatg

*Homo sapiens*
nuclear factor of kappa light polypeptide gene enhancer
in B-cells 2 (p49/p100) (NFKB2):

(Seq ID No: 210)

tgcccctcccggccaa
gcccaactccggatctcgctctccaccggatctcacccgccacaccg
gacaggcggctggaggaggcgggcgtctaaaattctgggaagcagaacctggccg
gagccactagacagagccgggcctagcccagagacatg

*Homo sapiens* non-metastatic cells 2, protein
(NM23B) expressed in (NME2):

(Seq ID No: 211)

gcccctcctccgccgccggctcccgggtgtggtggtcgcac
cagctctctgctctcccagcgcagcgccgccgcccggcccctccagcttcccggaccatg

*Homo sapiens* nucleophosmin (nucleolar
phosphoprotein B23, numatrin) (NPM1):

(Seq ID No: 212)

gcgtcctttccctggtgtgattccgtcctgcgcggttgttctctggagcagcgttctttt
atctccgtccgccttctctcctacctaagtgcgtgccgccacccgatg

*Homo sapiens* 5'-nucleotidase, ecto (CD73) (NT5E):

(Seq ID No: 213)

cattccttttgtagaaaaacccgtgcctcgaatgaggcgagactcagagag
gacccaggcgcggggcggacccctccaattccttcctcgcgcccccgaaagagcggcg
caccagcagccgaactgccggcgcccaggctccctggtccggccgggatgcggccgg
tacccgctccccgccgggaacaacctctccactcttcctg
cagggagctggtgccagccgacagccgcgccagggccgctccgggtaccagggtcg
gatcgggtgacgtcgcgaacttgcgcctggccgccaagccggcctccaggctgaa
gaaggaccgccccggccttgacccgggccccgcccctccagccggggcac
cgagcccccggccctagctgctcgcccctactcgccggcac
tcgcccggctcgcccgctttcgcacccagttcacgcgccacagctatg

*Homo sapiens* phosphatidylethanolamine binding protein 1
(PEBP1):

(Seq ID No: 214)

gcgtcttcccgagccag
tgtgctgagctctccgcgtcgcctctgtcgcccgcgcctggcctaccgcggcac
tcccggctgcacgctctgcttggcctcgccatg

*Homo sapiens* poly(A) binding protein, cytoplasmic 1
(PABPC1):

(Seq ID No: 215)

gcttccccttctccccggcggttagtgctgagagtgcggag
tgtgtgctccgggctcg
gaacacacatttattattaaaaaatccaaaaaaaatctaaaaaaatcttttaaaaaaccc
caaaaaaatttacaaaaaatccgcgtctccccgccgga
gacttttatttttttttcttcctcttttataaaataacccggtgaagcagccgagac
cgacccgcccgcccgcggccccgcagcagctccaagaaggaaccaagagac
cgaggccttcccgctgcccggacccgacaccgccaccctcgctccccgccggcagccgg
cagccagcggcagtggatcgaccccgttctgcggccgttgagtag
ttttcaattccggttgatttttgtccctctgcgctt
gctcccccgctccctccccccggctccggcccccagcccggcac
tcgctctcctcctctcacggaaaggtcgcggcctgtggccctgcgggcagccgtgccga
gatg

*Homo sapiens* proprotein convertase subtilisin/kexin type 2
(PCSK2):

(Seq ID No: 216)

cgctctttctctccggtacacacagctccccacattcg
caccccctgcccgcgcgccgggccgcctgactgcacggcttcccctccagccagatgctg
gagaacacacactgattcgctgctttccaagaccctgttcagtctctttctctata
caaagatttttttaaaaactatatataagaattctttatttgcaccctccctccgag
tcccctgctccgccagcctgcgcgcctcctagcaccacttttcactcccaaagaaggatg

*Homo sapiens* phosphogluconate dehydrogenase (PGD):

(Seq ID No: 217)

gggtctttccctcactcgtcctccgcgcgtcgccgctcttcggttctgctctgtccgccg
ccatg

*Homo sapiens* phosphoglucomutase 1 (PGM1):

(Seq ID No: 218)

cgctccccttttcccctcccgccggacctgccaggaggtgggctggcgcg
gagggagggccctgtccctgtccctttaaggaggagggccaaacgccggcctagag
tgcggcgtagccccacccgccgtgccctcacccagagcagctg
cagcctcagccggccgcccctccgccagccaagtccgccgctctgacccccggcag
caagtcgccaccatg

*Homo sapiens* solute carrier family 25 (mitochondrial
carrier; phosphate carrier), member 3 (SLC25A3):

(Seq ID No: 219)

cggcctctgtgagccgcaacctttccaagggagtggtt
gtgtgatcgccatcttagggagtgagtgtggccgggccttctcctgtggcgggtgtggg
gagcggagcccagagctcctgtggggccgctgctttggcggtgggcccagccggag
cagcctctttcgaaggccgccgtgacctcttcaagggcgtggagacgg
gaaggaaaaggccccggttggggttccagggcgccggtaacgttaaccggcgcctt
gcctgtcctctaaccgtcgctccctcctccctagaaagatg

*Homo sapiens* pim-1 oncogene (PIM1):

(Seq ID No: 220)

cctccccttactcctggctgcggggcgagccgggcgtctgctg
cagcggccgcgtggctgaggaggcccgagaggagtcggtggcagcggcggcggcgg
gaccggcagcagcagcagcagcagcagcagcagcaaccac
tagcctcctgccccgcggcgctgccgcacgagccccac
gagccgctcaccccgccgttctcagcgctgcccgaccccgctggcgcgccctcccgccgc
cagtcccggcagcgccctcagttgtcctccgactcgccctcggccttccgcgccagccg
cagccacagccgcaacgccacccg
cagccacagccacagccacagccccaggcatagccttcgg
cacagccccggctccggctcctgcggcagctcctctgggcac
cgtccctgcgccgacatcctggaggttgggatg

*Homo sapiens* pyruvate kinase, muscle (PKM2):

(Seq ID No: 221)

ggatctcttcgtctttgcagcgtagcccgagtcggtcagcgccggaggtgagcggtg
caggaggctacgccatcagtccccaccaagggccagtcgcccggctagtgcg
gaatcccggcgcgccgccgggcccgggcacgcaggcagggcggcgcag
gatccagggcgtctgggatgcagtggagctcagagagaggagaacggctcctcac
gcctggggcctgctcttcagaagtccccagcgccgttccttccagatcaggacctcag
cagccatg

*Homo sapiens* pleiomorphic adenoma gene-like 1 (PLAGL1):

(Seq ID No: 222)

cggcctcctcggcgcagccatcctcttggctgccgcgggcggcaaagcccacggcatctg
ccatttgtcattcagcccgtcggtaccgccccgagccttgatttagacacggctggggcg
tgctctggcctcactctccgggcgggtgctggacggacggacggacgggcagccgtgct
cacagctcagcagcgcggggccttggcgcgcgggcgcttccccgggtcgccgtcatggc
cgcggaggtggcacgcccgagcggcctcgcctgagctccgggggtcgtcgccccgcaggg
attgctgtcacgtctaatgtggctgctgcctcgtgtcacatctgaaactcatctgtacct
cacttagaaagtggttctgattagacaagacttttcgttgcagtcgacagaaacctaatg
ggaccattgaagaattccaaacaggtatttgcataggaatcagaggagttaatcttgtct
cttctcacaggtttgaatcttcagacaaacttctgggaggactcggtccctgcctcgcag
cagatgttccctgtcactcagtaggcatatg

*Homo sapiens* phospholipase D2 (PLD2):

(Seq ID No: 223)

tgctctcttggctccggaaccccgcgggcgctggctccgtctgccagggatg

*Homo sapiens* proteolipid protein 2 (colonic
epithelium-enriched) (PLP2):

(Seq ID No: 224)

ccccccttcccggccagacggcggg
caagacagctgggtgtacagcgtcctcgaaaccacgagcaagtgag
cagatcctccgaggcaccagggactccagcccatgccatg

*Homo sapiens* pinin, desmosome associated protein (PNN):

(Seq ID No: 225)

cag
tcctttcgcgcctcggcggcgcggcatagcccggctcggcctgtaaagcagtctcaa
gcctgccgcagggagaagatg

*Homo sapiens* phosphoribosyl pyrophosphate amidotransferase
(PPAT):

(Seq ID No: 226)

ggtccttccacgtgctttcggcggcgacatg

*Homo sapiens*
protein phosphatase 1, catalytic subunit, gamma isozyme
(PPP1CC):

(Seq ID No: 227)

tgttcttctcgtggttccagtggggagagaaggag
gaagtagggagcggggtggcagggggggacccgccgcggctgctgccaccgccgccac
caccgcctctgctcgtggcgtgggaaggaggtgtgag
tcccgggcgcgagccggcggcgcggcgccgctgcgggagggtcggcggtgggaaggcgatg

*Homo sapiens* protein phosphatase 1, regulatory subunit 8 (PPP1R8):

(Seq ID No: 228)

cggtcttccagtttcccggcgtgcttagggcgcgccaaatgggagggg
gagacgcaagatg

*Homo sapiens* protein phosphatase 6, catalytic subunit (PPP6C):

(Seq ID No: 229)

cggcctccgccgctgccgccgccgctgctacagccgccgccgccgctgtt
gccgcggcttgttattcttaaaatg

*Homo sapiens* protein kinase C substrate 80K-H (PRKCSH):

(Seq ID No: 230)

ctttctttctgcagcaggaaccgcggctgctggacaagaggggtgcggtggatactgac
ctttgctccggcctcgtcgtgaagacacagcgcatctcccgctg
taggcttcctcccacagaacccgtttcgggcctcagagcgtctggtgagatg

*Homo sapiens* mitogen-activated protein kinase 6 (MAPK6):

(Seq ID No: 231)

cgcccccctcttcctcgccctctctcgcgggtcggggttacatggcggcgactgcggcaaa
gcgagagcctcggagacgccgctgccgccagcacagccggagacctgagccgacactggg
ggcagtccgcgagccccgcactctctcgatgagtcggagaagtcccgttgtatcagagta
agatggacggtagctttgattgtgattgtggtgagctggagccacctgatcactaacaaa
agacatcttctgttaaccaacagccgcagggcttcctgttgaaataaatatatagcaac
aaaggaaaaaagaagcaaaacggaaatagtgcttaccagcaccttagaatgatgctgct
caggaccagtccaacactgaatgtatctgcactgtgaggagaatgttcatagaagcctgt
tgtgtgcatatttattcacattttgttaaatgttaaatcgtttagcacggtaatctgag
tgcacagtatgtcatttcattccgtttgagtttcttgttttcgttaaatgtctgcagagt
tgctgccctttcttgaactatgagtactgcaatcttttaattctcaatatgaatagag
cttttgagctttaaatctaagggaactcgacaggcctgtttggcatatgcaatgaaca
tcaagaaaccatcttgctgtggaagcataattattttcttctccctttttgaaagatct
ttcctttgatgccagttttcttccttgtttacacaagttcaatttgaaaggaaaaggca
atagtaagggtttcaaaatg

*Homo sapiens* phosphoribosyl pyrophosphate synthetase 2 (PRPS2):

(Seq ID No: 232)

cctcccccttccctacatctagccgccgcgcttttcccgctcccgcagcag
cagcctcccgcgtcgctgtcgctgttgcctccgccac
ctcctccgccgccgcgcgccctcggagttccgcgccccaccatg

*Homo sapiens* phosphoribosyl pyrophosphate synthetase-associated protein 1 (PRPSAP1):

(Seq ID No: 233)

ttgcctctggctctgaggcggcggcgccgggcgctgcgaaggctcggccgctgtag
tcagtggtgtggggtgcgcaagggcacggacctcggagctctccccgcttgcgccgag
tttctcagcgccttcccccacccaaaccggggtctcgcagtcggaagcactcagagtg
cagccccgcgcggggccggtcgtaaccgcgccgcgggccggacgatg

*Homo sapiens* proteasome (prosome, macropain) subunit, beta type, 5 (PSMB5):

(Seq ID No: 234)

ag
ttctttctgcccacactagacatg

*Homo sapiens* proteasome (prosome, macropain) 26S subunit, non-ATPase, 13 (PSMD13):

(Seq ID No: 235)

tgttcttctgtgccgggggtcttcctgctgtcatg

*Homo sapiens* protein tyrosine phosphatase, receptor type, N (PTPRN):

(Seq ID No: 236)

cagcccctctggcaggctcccgccagcgtcgctgcggctccggcccgg
gagcgagcgccggagctcggaaagatg

*Homo sapiens* RAB3A, member RAS oncogene family (RAB3A):

(Seq ID No: 237)

ctcccttttgcaggacgtcacggaggactg
caggggcctgagccgctgctgccgccgccgccgcgcagccccacatcaacgcac
cggggtcctgtcaccgccaccgccaaaaaagtcaccgccgctagggtcgccgtt
gcatcggtgcagggcaagatg

*Homo sapiens*
RNA binding motif, single stranded interacting protein
2 (RBMS2):

(Seq ID No: 238)

ctctctctctctctctcgctcgttccctaacattaaaga
gaaaatg

*Homo sapiens*
reticulocalbin 1, EF-hand calcium binding domain
(RCN1):

(Seq ID No: 239)

gcgcccctctgctccggctcggggcgggcactggcggagggactggccag
tcccctcctccgcgccggccccaaccctgtcgctgccgccgcgctccgag
tccccattcccgagctgccgctgtt
gtcgctcgctcagcgtctccctctcggccgccctctcctcgggacgatg

*Homo sapiens* radixin (RDX):

(Seq ID No: 240)

ccgccttttcccgcg
gaggcgccgagcggccatattgcg
gagctgtctgcggtggcggcggcgcctctcgtctcccgcgggcccagcgctcgcaccac
cgcttctccctccctgtcgcagccgcgccgccgcgcagcgccccagccacac
gccggcgggcagaagccgcccgctctccggaaagtgataacagaattcattgaagtgga
gaattttttaaagaaggtaacaaaaagagaaagaaaatg

*Homo sapiens* replication factor C (activator 1) 1, 145 kDa
(RFC1):

(Seq ID No: 241)

tcgccttcttgcacttcgcgggagaagttgtt
ggcgcgaatggatcctgagcctcgataacagattcctcaac
cggcccacccgccagccagccagcgccttcatcctggggctgcgatg

*Homo sapiens* ring finger protein 4 (RNF4):

(Seq ID No: 242)

gcatctttctcgag
gagctctcctgggcggctgaagaaggagcttcttctccggag
tgcgccggcggtggcgcctgcggacctaactagctccaggttaggccgagctttgcgg
gaaagcagcggacttgaaaatactggaaatctgtccggatccaaattattttgcaa
gccagatgagtaaccagagggcatgaaaggttgagaacatttgacttccctgcaaac
cttggtatagatcacttccttttctgtaggaaaggaaaggcaccaaagagcacaatg

*Homo sapiens* ribophorin I (RPN1):

(Seq ID No: 243)

tgctcttcccggtcatg

*Homo sapiens* ribosomal protein S27a (RPS27A):

(Seq ID No: 244)

cgttcttccttttcgatccgccatctgcggtggagccgccaccaaaatg

*Homo sapiens* secreted and transmembrane 1 (SECTM1):

(Seq ID No: 245)

cttcctttagcgtgaaccgcgggtgcggtgcctcccgtgaaaataataaattcac
cgtcacgcttgttgtgaacgcgggtggttcccgaaacttggaggcttccg
taaacccagctccttcctcatctgg
gaggtgggtcccgcgcgggtccgccgcctcctccctggcccctccctctcgtgtctttca
ttttcctggggctccggggcgcggagaagctgcatcccagaggagcgcgtccaggagcg
gacccgggagtgtttcaagagccagtgacaaggaccaggggcccaagtccaccagc
catg

*Homo sapiens* small glutamine-rich tetratricopeptide repeat
(TPR)-containing, alpha (SGTA):

(Seq ID No: 246)

ctttcttttgcg
caggcgtcgcgccctggggccggggccgggcggcaccgcggtgcgcaagcgcaac
cgtcggtgggtcgggatcggtcgcctgagaggtatcacctcttctgggctcaagatg

*Homo sapiens*
SH3 domain binding glutamic acid-rich protein like
(SH3BGRL):

(Seq ID No: 247)

agttctccttccaccttcccccacccttctctgccaac
cgctgtttcagcccctagctggattccagccattgctg
cagctgctccacagcccttttcaggacccaaacaaccgcagccgctgttcccaggatg

*Homo sapiens* solute carrier family 1 (glutamate/
neutral amino acid transporter), member 4 (SLC1A4):

(Seq ID No: 248)

cgccctcctacttcccgtctgcgtccgcgttcgcggctcccgttt
gcatcatcccgtctgcgtccgcgttcgcggctcccgttt
gcatcatctccagccggcggctgctccagggaggctgggcgcgatcctctccgcccgcgg -continued
ctccaacccgcactctgcgcctctcctcgcctttctcgcac
ctgctcctgcgccaggcccggagaccccggggcggcttcccagaacctgcggag
cacaactggccgaccgacccattcattgggaaccccgtcttttgccagagcccac
gtcccctgccacctctagctcggagcggcgtgtagcgccatg

*Homo sapiens*
small nuclear RNA activating complex, polypeptide
2, 45 kDa (SNAPC2):

(Seq ID No: 249)

ctgcctctttctgagcggcatg

*Homo sapiens* sorting nexin 1 (SNX1):

(Seq ID No: 250)

ctatctctcga
taaagttgttgttgcggcttccgccgcgggtggaagaagatg

*Homo sapiens* signal recognition particle 54 kDa (SRP54):

(Seq ID No: 251)

ctatctctcatctttccgctcttagctgggagtgctccgcctagtcac
ttttcttaaggtggctcgtcgaggcctgacttcttccccgaaatcacgtccctaga
cagcctcctattttaccactaactttactcctgcagttattcagcggtag
gaaactgaaaccaaaaaccagtgtaagcaagtaaacatctaaactgtttcag
gagccgcgtagaaggaacgcggcggtgtgccccggaagcggaagtagattctcctata
gaaaggctggactacgcggagtggtgacgtttcctcattgggcggaaggttcgctgg
cactccgttggtcttccagctggtgggagttgacgacgtggtgctgggcgttgg
gaccctactttatctagttcgggaagttgggttgtggggtcat
acctgtctgtctgctcccagctttcttgggtttcttccgac
ggcgtggggcctcgctaaggaattcccggcccctcagggccac
ggctttagcggtgtcttttgcgagttcttcgtaagtacatcttaaagctgtcaagatg

*Homo sapiens* signal sequence receptor, beta (translocon-
associated protein beta) (SSR2):

(Seq ID No: 252)

cggtctttcggatgctgac
gctctcttcctgtctttgtggctccggaaaggcgtttgggatgccaacgatg

*Homo sapiens*
signal transducer and activator of transcription
6, interleukin-4 induced (STAT6):

(Seq ID No: 253)

ttttcttttggtggtggtggtg
gaagggggaggtgctagcagggccagccttgaactcgctggacagagctacagac
ctatggggcctggaagtgcccgctgagaaagggagaagacagcagagggtt
gccgaggcaacctccaagtcccagatcatg

*Homo sapiens* suppressor of Ty 4 homolog 1 (*S. cerevisiae*)
(SUPT4H1):

(Seq ID No: 254)

tgttcttcccatcggcgaagatg

*Homo sapiens* transcription factor 7
(T-cell specific, HMG-box) (TCF7):

(Seq ID No: 255)

ggtccttcccctaaaacttggcactgccgatactcccagcccgttccttcccaagtcagg
aacttgcaggggaccccttggcaattcttttctctcaagagcagacagccttcagtccc
agccgctgccagggctggtgtgtctgacccagctgtggttttccaggcctgaaggcccc
ggagtgcaccagcggcatg

*Homo sapiens* TEA domain family member 4 (TEAD4):

(Seq ID No: 256)

cagtctcctccccgaggtgccggtggccccgccgccac
tccctccggctccctccctcccgccgcggcgcgcatctcattccagccctcattccgcg
cattccagcgtcctcctcgcacactcgaggcaggggggcgggagggccg
cagctccggcgccgccgcgtcccgccaggtgagaggcgcccgcgcccgccg
cacccgccggcgccctcacgggccgcgcgccccacgccgccagccgac
cgctcgcgccgcgtgctcggctgctctttctttccgccgccgcgttcccgcctt
ggacctctgcgctccgacgcgctccgtcccgac
ctctggcttccctccgcgctccggcgctgctcgctgcccctctcccgcttccctcctgtc
cgccccgcgctcccctcctcgctcccggttgactcactcctccaggaa
tagggatccccgtgttttcccgtcagtcccattctgg
gaaaactcctccctccgcgcgctccgctccgctccgctgggcgcac
cggggccggtcggcgcggggtgggcttggccccgcggccccgccttcac
tgcgccgcccgtcggcccccggccggagcccggctctgcgcgtgac
gccctgtcgtccccgcagaacgatcgccgcggccggaagagttggcgctcggggcg
gactccttggaactggcttagcgcacccatcccaccttcccgcaccctgggaccggtcg
gaacgagctgattgcccgctacatcaagctccggacagggaagacccgcaccaggaa
gcaggtctccagccacatccaggtgctggctcgtcgcaaagctcgcga
gatccaggccaagctaaaggaccaggcagctaaggacaaggccctgcagagcatg

*Homo sapiens* G protein-coupled receptor 137B (GPR137B):

(Seq ID No: 257)

ttttctttcctccagtctcggggctgcaggctgagcgcgatgcgcgga
gaccccgcgggggcggcggcggccgtgagccccgatg

*Homo sapiens* tumor protein, translationally-controlled 1 (TPT1):

(Seq ID No: 258)

cggccttttccgcccgctccccctcccccgagcgccgctccggctgcac
cgcgctcgctccgagtttcaggctcgtgctaagctagcgccgtcgtcgtctcccttcag
tcgccatcatg

*Homo sapiens* ubiquitin A-52 residue ribosomal protein fusion product 1 (UBA52):

(Seq ID No: 259)

ctatcttcttttttcttcagcgaggcggccgagctgacg
caaacatg

*Homo sapiens* ubiquinol-cytochrome c reductase core protein II (UQCRC2):

(Seq ID No: 260)

cggcctccgccaccatcttgctttcctttaatccggcagtgac
cgtgtgtcagaacaatcttgaatcatg

*Homo sapiens* ubiquitin specific peptidase 1 (USP1):

(Seq ID No: 261)

ctgcctttcgtgtctctgcagcgtggagactggaaccggcaatttcaaaggacgccacgt
tcaatcgcagcgctggcgcgggcggaggctaaaacacggggtcctgagactgaggaaaa
cgcgccaagttcccctcggtggcggagtgctaaagaccctagcggttcaggcgttcggcg
agcggggccgctgcttgttgcgctcctggctctccggggcgggcgcagatgggcgccgc
tcccgggatgtagttggtgttggtgcaagacgggagcgagcggcggtcggggttcccgct
cttgggagcggatggtcactcccccgcggggagggcgagccgaccagatttcctgggc
cggggacccggcgggctcggggcagggactcacctgtcgcacccacactcattcgggttg
gacttgccggcgtcaccgccgcggacttcgctttgggccatgaccagatataattggtga
ttacaactttcctctataaattaactcttgacactccttgggatttgaagaaaaaaatg

*Homo sapiens* voltage-dependent anion channel 2 (VDAC2):

(Seq ID No: 262)

gtgtctccttcacttcgccctccagctgctggagctgcagcccgac
cgcgagcgtgccaagcggcttcagcagctagcggagcggtggcggcggccccctcag
gacaccaccagattcccctcttcccgcgggcctcgccatg

*Homo sapiens* vimentin (VIM):

(Seq ID No: 263)

gcctcttctccgggagccagtccgcgccac
cgccgccgcccaggccatcgccaccctccgcagccatg

*Homo sapiens* very low density lipoprotein receptor (VLDLR):

(Seq ID No: 264)

cccctccccgctgctcacccgctctccggccgccgccggtgcgggtgctccgctac
cggctcctctccgttctgtgctctcttctgctctcggctccccaccccctctcccttcc
tcctctcccttgcctcccctcctctgcagcgcctgcattatttctgcccg
caggctcggcttgcactgctgctgcagcccggggaggtggctgggtgggtggggagga
gactgtgcaagttgtaggg
gagggggtgccctcttcttccccgctccctccccccgccaactccttcccctccttctcc
cccttttcccctccccgcccccaccttcttcctcctttcggaaggactggtaactt
gtcgtgcggagcgaacggcggcggcggcggcggcggcggcaccatccaggcgggcac
catg

*Homo sapiens* wingless-type MMTV integration site family, member 10B (WNT10B):

(Seq ID No: 265)

agtcctttgctcgccggcttgctagctctctcgatcac
tccctccccttcctccctcccttcctcccggcggccgcggcggcgctggggaa
gcggtgaagaggagtggcccggccctggaagaatgcggctctgacaaggg
gacagaacccagcgcagtctccccacggtttaagcagcactagtgaa
gcccaggcaacccaaccgtgcctgtctcggaccccgcacccaaaccactg
gaggtcctgatcgatctgcccaccggagcctccgggcttcgacatg

*Homo sapiens* CCHC-type zinc finger, nucleic acid binding protein (CNBP):

(Seq ID No: 266)

cagcctctaccttgcgagccgtcttccccaggcctgcgtccgag
tctccgccgctgcgggccgctccgacgcggaagatctgactgcagccatg

*Homo sapiens* zinc finger protein 43 (ZNF43):

(Seq ID No: 267)

gggccttt
gtctctggctgcagttggagctctgcgtctcgtcttcgttcttctgtgtcctctgctgct
agaggtccagcctctgtggctctgtgacctgcggggtattgggggatccacagctaagac
gccaggaccccccggaagcctagaaatg

*Homo sapiens* zinc finger protein 74 (ZNF74):

(Seq ID No: 268)

cagtcctttgtgggagtccggtctgtccacttgccggtccctcagaccgtcggcggtct
ctgtccgcttcgggacctgtccgctggtcgctccgcgtccgatggctcctggccgcggaa
ccttaggcctggccctggtctccgagcgcgggttcgccggggaggagcgtgtggcgggggt
gtgccggggcgtgagtgcgccgagcatggggctgagcctggtgtggggagtgggtatctg
cggagccggcctgaaccccacctcagccgggcgcgggggaggggctccgtgcgtgtgatc
gtgcagctgtgagcgcgtggccgcccgcggggctccgctgcaggcccctcagcccagg
agcagtactcgctcttcagggcctgccctggatcctggaggctacacagctgcccactcc
tcctggggaggctgccgtggaggccatg

*Homo sapiens* zinc finger protein 85 (ZNF85):

(Seq ID No: 269)

gggcctttt
gtctctcgctgcagcctgagctctaggtcttgttttccctgcttt
gtgttttctgctcgtggacgcccagcctctgtggccctgtggcctgcaggtattggga
gatccacagctaagacgccgggaccccctggaagcctagaaatg

*Homo sapiens* zinc finger protein 91 (ZNF91):

(Seq ID No: 270)

gggcctttt
gtctctcgctgccgccggagtttccaggtctcgacttcac
tgctctgtgtcctctgctccaggagggcccagcctgtgtggccctgtgacctg
caggtattggagagccacagctaagatg

*Homo sapiens* zinc finger protein 141 (ZNF141):

(Seq ID No: 271)

gggtctttt
gcgtctggctactaccagaccgcgggttaggggcttcatctctctgcgttctcagtt
gtgggaggccttggtgattcggccacagcctcagcctccgtcgctctgtgacctgcggg
tattggatgattggtagctaagactcccgaatacttcagaagtggggaaatg

*Homo sapiens* zinc finger protein 205 (ZNF205):

(Seq ID No: 272)

tgttctttctagctctgaaatagaaaatg

*Homo sapiens* transmembrane protein 187 (TMEM187):

(Seq ID No: 273)

ctcccttttcggagatttgaatttcccccagcgaggcgagtgaggcgaaataccccg
tatggtgatagctggccttttcgcgccaatactgaaaaaggcagaac
gttcctccgctggcgccagccaatcagcaggactcctgccttccttcggggcaaggtcg
cagcatctgcctcggaaatcacgaaatcacggggcttctttctgctggctcagccgg
gaggcccagagtgttctgcagaggctgcgtattgaaggctgctctctgaa
gctccctgccccaggtcacgccgccggttccagatg

*Homo sapiens* histone cluster 2, H2be (HIST2H2BE):

(Seq ID No: 274)

acttcttttcttggctaagccgcgtttgtactgtgtcttaccatg

*Homo sapiens* solute carrier family 25 (mitochondrial carrier; oxoglutarate carrier), member 11 (SLC25A11):

(Seq ID No: 275)

ccgcctttgcgctgcgcgcctgcgcccgcgccggcttccagcgggtgtcggacctga
gagctggaggggcgtgcgcgcgccctcgctctgttgcgcgcgcggtgtcaccctt
gggcgcgagcggggccgcgcgcgcacgggacccggagccgagggccattgagtggcgatg

*Homo sapiens* tyrosylprotein sulfotransferase 2 (TPST2):

(Seq ID No: 276)

cctcccccttcccccggctggggcggctggagagccgggagtcgctgggtgcgtgggcctg
cctcgccgcgtctcgccacgggctctgccagcagacagccttggcacacaggcacaaggg
ctggagcccagagatgagagtgcccaagggagatgtgagcctggcgggctgcccgctaac
ctgtcgctgaagccccagaagcgggccctcaggccaggcctaccctgcctccggcccag
catg

*Homo sapiens* sorbin and SH3 domain containing 2 (SORBS2):

(Seq ID No: 277)

aagcctcttttatacatctcttcagggaagagagaagcaatgggcatgttagtata
caatgatcacagccacgcaggcctgcaagctgcctttggacaggctgtt
gactgccgttccaattagctgattggagaatgtggaatgcagagtgataatgctgcata
tctgctatcaggcagcagcaaaggttttgtcttgggaaggcaagctttccctgcaa
tattatctcagcagctcccctagctgcttaccctgaaaacgagggatccaaac
ggagggtgttgcactctgctaacgctggtcctgtgcgtggctgtggcatatgagcgg
caggtctgaaaaagcaggtgtgtgctgggacgggcactggactggaacgcaggcggac -continued

```
gctctcgggtttacctgcttcctgttaacagattgtgggctcccagggcatatgtctg
cacgctgaggccgaggcggagaagggggcttcctgagcgtcccagtacactgacagaga
cacttggattggacttaatcttaaacctctggagttcaagac
cttttaaaaagggctaaataaacaatctctacatgtaaaaggccactgactcc
tacttcctctgtatagagcaactgttgaactcagctgcctgtaggaaaactgaa
gactttaataacaaactctccaaggtgaaaatg
```

Homo sapiens G protein-coupled receptor 65 (GPR65):

(Seq ID No: 278)

```
gtttctcttcttgacttgatgcaggcacagatttatcaagctcctcag
tcaacaaacacatcaccggaagaaatatggaaggaaaggaatttttaaaaggaaatac
caatctctgtgcaaacaaagccttgtatattcatgtttgcaccaatctactgtgagat
ttatgaagaaaaacaaattgcggacaactctctatgtacacttacaaatgcctcagtt
gatgcttgtgggctgtttgtcagcgttctgtga
taatgaacacatggacttctgtttattaaattcagttgaccccttagccaattgccag
gagcctggatttttacttccaactgctgatatctgtgtaaaaatt
gatctacatccaccctttaaaagcattgatgaattaattagaacttagacaacaaa
gaaaaattgaaaagaattctcagtaaagcgaattcgatgttcaaaacaaactacaaa
gagacaagacttctctgtttactttctaagaactaatataattgctac
cttaaaaaggaaaaatg
```

Homo sapiens nipsnap homolog 1 (C. elegans) (NIPSNAP1):

(Seq ID No: 279)

```
gggccttcctgcaacctttgcggctccaacatg
```

Homo sapiens inhibitor of kappa light polypeptide gene enhancer in B-cells, kinase complex-associated protein (IKBKAP):

(Seq ID No: 280)

```
gcttctttgcagcgcttcagcgttttcccctggagggcgcctccatcctt
ggaggcctagtgccgtcggagagagagcgggagccgcggacagagacgcgtgcg
caattcggagccgactctgggtgcggactgtgggagctgactctggg
tagccggctgcgcgtggctggggaggcgaggccggacgcacctctgttt
gggggtcctcagagattaatgattcatcaagggatagttgtacttgtctcgtgg
gaatcacttcatcatg
```

Homo sapiens COP9 constitutive photomorphogenic homolog subunit 3 (Arabidopsis) (COPS3):

(Seq ID No: 281)

```
ctgccttcgccgctcgggccgcccggggggaaaacatg
```

Homo sapiens pirin (iron-binding nuclear protein) (PIR):

(Seq ID No: 282)

```
ccgcctcctctaggccgccggccgcgaagcgctgagtcacggtgaggctactg
gacccacactctcttaacctgccctccctgcac
tcgctcccggcggctcttcgcgtcaccccgccgctaaggctccaggtgccgctaccg
cagcgtgagtacctgggggctcctgcaggggtccactagccctccatcctc
tacagctcagcatcagaacactctcttttagactccgatatg
```

Homo sapiens THO complex 5 (THOC5):

(Seq ID No: 283)

```
ccttccttacttccggttctc
tatggtgcgcgggcaagctttgctccgcctccggcag
tggcttactcccggtgccaggttcttggagctgtgaggaggaacaaccatg
```

Homo sapiens RuvB-like 1 (E. coli) (RUVBL1):

(Seq ID No: 284)

```
gggcctttt
gcaaaattgccctagtaacggccgcatggtaactcaggcgccgggcgcac
tgtcctagctgctggttttccacgctggttttagctcccggcgtctgcaaaatg
```

Homo sapiens Kruppel-like factor 7 (ubiquitous) (KLF7):

(Seq ID No: 285)

```
tttccttttagttgactgaaacaaaacaaaacaaaagggccactg
gatgtctgccttcttgggggtgagccaga
cagactgacaaacaaacagccccaactgtgttcggggagggtttcgcctcccgttt
gcccggcagcagcagcatg
```

Homo sapiens USO1 vesicle docking protein homolog (yeast) (USO1):

(Seq ID No: 286)

```
gctccccttttgccttcaaccttcgagccgccacgtaatgccac
gtccccgcgcatgcgcatcttggccgctgctggcggctgtttccgggcttagagggctg
gagtggccgccgagttggaggcggtggtggcagcagtaggagtgtgtagagtgcgg
gattgggggccaggccctgcggagggcgggggaagttgtcttcttttttttccg
gaggggccggtaaacctggtggctgaacggcaagatg
```

-continued

*Homo sapiens* unc-5 homolog C (*C. elegans*) (UNC5C):

(Seq ID No: 287)

ccccttttggccccctgcctttggagaaagtggagtgtggcgcttggtt
gtcgttatttcttcggactgcttcgcggtgcacggattcagcttctgcccag
tggggctttcagctgtttgcgcgtctctctgtccccctccctccccccggcacac
ctctgtctacgatg

*Homo sapiens* RNA terminal phosphate cyclase domain 1 (RTCD1):

(Seq ID No: 288)

gcttcttccgctttctcgtcaggctcctgcgcccaggcatgaac
caaggtttctgaactactgggcgggagccaacgtctcttctttctcccgctctggcg
gaggctttgtcgctgcgggctgggccccagggtgtccccatg

*Homo sapiens* eukaryotic translation initiation factor 3, subunit A (EIF3A):

(Seq ID No: 289)

ggctccttccttccgtctctggccggctgggcgcgggcgactgctggcgaggcgcgtgg
gaccttacgctggttcccccttcgtctcctctcccggcccgggccactagagagttcgctg
acgccgggtgagctgagcctgccgccaagatg

*Homo sapiens* eukaryotic translation initiation factor 3, subunit D (EIF3D):

(Seq ID No: 290)

gtttcctcttttcctggtttctcaagagtgctgctgctaac
gcggtccccggcacgcaccatctgttgccatcccggccggccgaggccattgcagat
tttggaagatg

*Homo sapiens* eukaryotic translation initiation factor 3, subunit F (EIF3F):

(Seq ID No: 291)

ccgcctccttctttctcgacaagatg

*Homo sapiens* eukaryotic translation initiation factor 3, subunit G (EIF3G):

(Seq ID No: 292)

cgctctctggccgggcttgggctgcgtggagaatactttttg
cgatg

*Homo sapiens* eukaryotic translation initiation factor 3, subunit H (EIF3H):

(Seq ID No: 293)

gtttctctttcttcctgtctgcttggaaagatg

*Homo sapiens* eukaryotic translation initiation factor 3, subunit I (EIF3I):

(Seq ID No: 294)

aaaccttttccggtcttactcacgttgcggccttcctcgcgtca
cagccgggatg

*Homo sapiens* eukaryotic translation initiation factor 3, subunit J (EIF3J):

(Seq ID No: 295)

ctccctctcacacacgctcacacccggctcgagatg

*Homo sapiens* poly(A) binding protein, cytoplasmic 4 (inducible form) (PABPC4):

(Seq ID No: 296)

ccgcctctctccgccccgggtcgctgccgcctccgccgcttttcgggcttcgcagcctgag
gaaaaaagagaaaagataaaaaaaatctgaaaacgcttcaaaatcctgaaaaaaaaaa
aggaaaagaaaaaacgaatcctcggagaacccgcggggaagtcactttcgtacgcttccg
gcctgccccgcccccgccgccgcagcgcttggcgtccgtcggtctccgtccgtcggtccg
gggtgagccgccccgccccgcccgccgtgccctccccccgctcgggcccccgagcccgcg
ccccgcgcctgccccggcgcaccacgtgtccgtgctgcccttcgccgcccgcccggggct
cgccgagtcggcgcccacaaagatttggtttccctctgccccggcggttgtaatcttaaa
ccgccggagcccgaggcctatatttatagagaaacgcgtgtcccgaggccgccgtgggc
agcgtccggtcgcctcttaaaggatttttaccccttcggaaggggattccccgtttaattt
tttccctactttgatttttttgaaattttggagcttcgcaccaggaccgcggagaagtgcaa
agtcgcggggagggccgtattgtgcggagagccttttgtctgcggtgctgcggccgtggg
agccggcccccgcctccgtttccgtcccgtctccaagcccgccgactccagctcgtcct
cgccgcgccggtgccacctgtgagccgcggcgcgggccccgggctccgaaggcgccctttt
gtcctgcggcgggcccgataagaagtcctcctggcggggctcggggtggtggggggcggg
gagatg

*Homo sapiens* receptor-interacting serine-threonine kinase 2 (RIPK2):

(Seq ID No: 297)

agctctttcgcggcgctacggcgttggcaccagtctctagaaaa
gaagtcagctctggttcggagaagcagcggctggcgtgggccatccggg
gaatgggcgccctcgtgacctagtgttgcggggcaaaaagggtctt -continued gccggcctcgctcgtgcagggcgtatctgggcgcctgagcgcggcgtgggagccttgg
gagccgccgcagcagggggcacaccggaaccggcctgagcgcccgggaccatg

*Homo sapiens* neuropilin 1 (NRP1):

(Seq ID No: 298)

ctttcttttctccaagac
gggctgaggattgtacagctctaggcggagttggggctcttcggatcgcttagat
tctcctctttgctgcatttccccccacgtcctcgttctcccgcgtctgcctgcg
gacccggagaagggagaatg

*Homo sapiens* guanine monphosphate synthetase (GMPS):

(Seq ID No: 299)

tggtcttctctcccgcggcgctggggcccgcgctccgctgctgtt
gctccattcggcgcttttctggcggctggctcctctccgctgccggctgctcctcgac
caggcctccttctcaacctcagccgcgggcgccgaccttccgg
caccctcccgccccgtctcgtactgtcgccgtcaccgccgcggctccggccctggccc
cgatg

*Homo sapiens* far upstream element (FUSE) binding protein 1 (FUBP1):

(Seq ID No: 300)

ttttctttctttcttagctgttagctgagaggaagtctctgaacaggcgg
cagcggctcttatagtgcaaccatg

*Homo sapiens* eukaryotic translation initiation factor 2B, subunit 5 epsilon, 82 kDa (EIF2B5):

(Seq ID No: 301)

gatccttttt
gtccctactgcgtgcggtggcagcttccttgcggaagtggtgaccgtgagagaagaa
gatg

*Homo sapiens* eukaryotic translation initiation factor 2, subunit 2 beta, 38 kDa (EIF2S2):

(Seq ID No: 302)

gtttcctttcgctgatgcaagagcctag
tgcggtggtgggagaggtatcggcagggg
cagcgctgccgccggggcctggggctgacccgtctgacttcccgtccgtgccgagcccac
tcgagccgcagccatg

*Homo sapiens* adaptor-related protein complex 1, sigma 2 subunit (AP1S2):

(Seq ID No: 303)

cctcccctctccgcctaa
gcctgccctatgccagccgggtgtcctccccacagcaccacggcttctcttcctcag
cacggcgacaggggcttccccttcgccgccgccgccgccgccggccaa
gctccgccgcgcccgcggcccgcggccgccatg

*Homo sapiens* suppression of tumorigenicity 13 (colon carcinoma) (Hsp70 interacting protein) (ST13):

(Seq ID No: 304)

cgccccttctgcgcggtcacgccgagccagcgcctgggcctggaaccgggccgtagccc
ccccagtttcgccaccacctccctaccatg

*Homo sapiens* solute carrier family 7 (cationic amino acid transporter, y+ system), member 7 (SLC7A7):

(Seq ID No: 305)

ctcccttttcttaaatgcttggggtgagagagaagagaggctagggtggggcatggag
gacacagagagagagagtgctgtgtattccttcccccgc
tactgtcctgtcctcagctaacttgctctgggacagcttccccagggctacagatactg
cactcagctgactgtcctttcttctgggccctggtcccagagcagagctgacaaagga
gattcctgagagagcaccttcttatcacagaaagtgctgagccaa
gagctcctagctgcccccttttgcagatgtgaagggccagtgaacctt
ggacccagatggttgcttaatactcctttccccctccctcactccttcctttt
gcgggctgcctcacctcctccaccttcttgcttaaatccataggcattt
gtctggccttcccttttactgctggctgggaaggaggagcatcagaccacagatcctg
gaaggcacttctctccctgactgctgctcacactgccgtgagaacctgcttatatccag
gaccaaggaggcaatgccaggaagctggtgaagggtttcctctcctccaccatg

*Homo sapiens* paired box 2 (PAX2):

(Seq ID No: 306)

ctcccttttctcctcaagtcctgaagttgagtttgagaggcgacac
ggcggcggcggccgcgctgctcccgctcctctgcctccccatg

*Homo sapiens* 5-aminoimidazole-4-carboxamide ribonucleotide formyltransferase/IMP cyclohydrolase (ATIC):

(Seq ID No: 307)

agccctcctacctgcg
cacgtggtgccgccgctgctgcctcccgctcgccctgaacccagtgcctgcagccatg

*Homo sapiens* ATP synthase, H+ transporting, mitochondrial
F1 complex, alpha subunit 1, cardiac muscle (ATP5A1):

(Seq ID No: 308)

ccttctttt
gcggctcggccattttgtcccagtcagtccggaggctgcggctgcagaagtac
cgcctgcggagtaactgcaaagatg

*Homo sapiens* cyclin G1 (CCNG1):

(Seq ID No: 309)

cggccccttcggctccgagctgaccctgatcagggccgagtt
gtctcggcggcgctgccgaggcctccacccaggacag
tcccctccccgggcctctctcctcttgcctacgagtcccctctcctcg
taggcctctcggatctgatatcgtggggtgaggtgagcaggcccggggagggtggttac
cgctgaggagctgcagtctctgtcaagatg

*Homo sapiens* cadherin 16, KSP-cadherin (CDH16):

(Seq ID No: 310)

agctctcttcttgcttggcagctggaccaagggagccagtcttgggcgctg
gagggcctgtcctgaccatg

*Homo sapiens* cyclin-dependent kinase inhibitor 1B
(p27, Kip1) (CDKN1B):

(Seq ID No: 311)

ttttcttcttcgtcagcctcccttccaccgccatattgggccactaaaaaaggggctc
gtcttttcggggtgttttttctcccctcccctgtcccgcttgctcacggctctgcgact
ccgacgccggcaaggtttggagagcggctgggttcgcgggacccgcgggcttgcaccgc
ccagactcggacgggctttgccaccctctccgcttgcctggtcccctctcctctccgccc
tcccgctcgccagtccatttgatcagcggagactcggcggccgggccggggcttccccgc
agccctgcgcgctcctagagctcgggccgtggctcgtcggggtctgtgtcttttggctc
cgagggcagtcgctgggcttccgagaggggttcgggctgcgtaggggcgctttgttttgt
tcggttttgttttttttgagagtgcgagagaggcggtcgtgcagacccgggagaaagatg

*Homo sapiens* chimerin (chimaerin) 2 (CHN2):

(Seq ID No: 312)

tctcctcttcttcctttgtgtgtgcgcgagcggagttggggcggagggagaagggg
gaggtcgctctgtctgtccgtctcccgccgcctctgccggtc
tactcgaagtgcggcgggagaggcgggagcccaggagagggtgcgg
gagctggcggggcggctcggagctgccaggacgccctggtcccagccgcgcacaggg
gagcgtggacggcagaggggctcggcgggagccga
gatccgcccgtcccggctgcccctcggcctccctctgctcccac
ctaccccctgacacccatagaaaagcgtgcaaaggcgcgggagcgggacggaaac
cacaaataaatagcggcggcggcagcgcgtcatctggtggagcaggaagtg
caggcagagtccggaggctggtgctttctgcgcgtccccaggactttt
gccatgggctgggggccgcggaggctgcgagcggccgggcgaggg
cagcggcggcgcgtccgcaccggggctgagcgagcagcgacgcgaggggcgcgcgga
gatg

*Homo sapiens* citrate synthase (CS):

(Seq ID No: 313)

gggcctccttgag
gaccccgggctgggcgccgccgccggttcgtc
tactcttttccttcagccgcctcctttcaaccttt
gtcaacccgtcggcgcggcctctggtgcagcggcggcggctcctgttcctgccg
cagctctctcccttcttacctccccaccagatcccgga
gatcgcccgccatggctttacttactgcggccgcccggctcttgggaac
caaggcacccagtggcaagtactagctgagcatttgggagatgcttgtcttactt
ggctgttgcttctcctgctgctggggaaaaggaatgcatcttgtcttgttctt
gcagcccggcatgccagtgcttcctccacgaatttgaaagacatattggctgacctga
tacctaaggagcaggccagaattaagactttcaggcagcaacatggcaagac
ggtggtgggccaaatcactgtggacatg

*Homo sapiens* cathepsin S (CTSS):

(Seq ID No: 314)

atttctttttcaagtcaatt
gaactgaaatctccttgttgctttgaaatcttagaagagagcccac
taattcaaggactcttactgtgggagcaactgctggttctatcacaatg

*Homo sapiens* deoxynucleotidyltransferase, terminal (DNTT):

(Seq ID No: 315)

cagtctccctcccttctggagacaccaccagatgggccagccagaggcagcag
cagcctcttcccatg

*Homo sapiens* dual specificity phosphatase 3 (DUSP3):

(Seq ID No: 316)

cgctctccgcctcgcttgctcctgccgggcgtgcagggccccgccgccgccatg

-continued

*Homo sapiens* coagulation factor II (thrombin)
receptor-like 2 (F2RL2):

(Seq ID No: 317)

catcctttccctgcggaggaccagggcaagtttcctgcctgcacggcacaggagagcaaa
cttctacagacagaccaaggcttccatttgctgctgacacatggaactgaggtgaaattg
tgctccatgattttacagatttcataacgtttaagagacgggactcaggtcatcaaaatg

*Homo sapiens* Fc fragment of IgG, receptor, transporter, alpha
(FCGRT):

(Seq ID No: 318)

cgtcctctcagcatg

*Homo sapiens* guanylate binding protein 2, interferon-inducible
(GBP2):

(Seq ID No: 319)

ttacctctttttcttgtctctcgtcaggtctctgacattgacagagcctg
gacgttggaggaagccccaggacgttggagggtaaagtaaaagtccacagttac
cgtgagagaaaaaagagggagaaagcagtgcagccaaactcggaagaaaagagaggag
gaaaaggactcgactttcacattggaacaaccttctttccag
tgctaaaggatctctgatctggggaacaacaccctggacatg

*Homo sapiens* G protein pathway suppressor 1 (GPS1):

(Seq ID No: 320)

cgctcttttctcccttcagcagccagccagctctgtgtcagggtcgggggtg
cagaaagtcaggacagaatg

*Homo sapiens* general transcription factor IIF, polypeptide 2,
30 kDa (GTF2F2):

(Seq ID No: 321)

gttcctcttttcctcggttcccagtgttctgg
caggtaaggaacgccggctcttcgcctctcagcgcggcttgtcctttgttccggac
gcccgctcctcagccctgcggctcctggggtcgctgctgcatcccgcacgcctccac
cggctgcagacccatg

*Homo sapiens* glycogenin 1 (GYG1):

(Seq ID No: 322)

cgctccctcccggtgccggcttctctgagtcaccaac
ctgaggctgccccggccgcctgcgcacccggcagcaccatg

*Homo sapiens* heat shock 70 kDa protein 9 (mortalin) (HSPA9):

(Seq ID No: 323)

agctctttgccgtcggagcgcttgtttgctgcctcgtactcctccatttatccgccatg

*Homo sapiens* iron-responsive element binding protein 2
(IREB2):

(Seq ID No: 324)

cttccttctttcctcccttgccag
tccgcctgtcttcctcccccgtcttccctgcccggcctcccccttcttcccccgctggccc
cctccccggagggataatatggtctccggcgatg

*Homo sapiens* origin recognition complex, subunit 1 (ORC1):

(Seq ID No: 325)

ccaccttcttttcatttctagtgagacacacgctttggtcctggctttcggcccgtag
ttgtagaaggagccctgctggtgcaggttagaggtgccgcatcccccg
gagctctcgaagtggaggcggtaggaaacggagggcttgcgggctagccggaggaa
gctttggagccggaagccatg

*Homo sapiens* RAB1A, member RAS oncogene family (RAB1A):

(Seq ID No: 326)

cattcctttctttcgattaccccgtggcgcggagagtcagggcggcggctgcggcagcaag
ggcggcggtggcggcggcggcagctgcagtgacatg

*Homo sapiens* cytohesin 2 (CYTH2):

(Seq ID No: 327)

gagtcttttcagcgctgag
gactggcgctgaggaggcggcggtggctcccggggcgttt
gagcgggctcacccgagcccgcgggccaacgcggatccaggcccgactggcgggac
cgccccggattcccgcgggccttcctagccgccatg

*Homo sapiens* COP9 constitutive photomorphogenic homolog subunit
2 (*Arabidopsis*) (COPS2):

(Seq ID No: 328)

atttctcctcccccctcccggccaagatg

*Homo sapiens* solute carrier family 9 (sodium/
hydrogen exchanger), member 3 regulator 1 (SLC9A3R1):

(Seq ID No: 329)

ggtcctctctcggctcctcgcggctcgcggcggccgacggttcctgggacacctgctt
gcttggcccgtccggcggctcagggcttctctgctgcgctcccggttcgctggacgg

```
gaagaagggctgggccgtcccgtcccgtcccatcg
gaacccaagtcgcgccgctgaccgtcgcagggcgagatg
```

Homo sapiens peptidase (mitochondrial processing) beta
(PMPCB):

(Seq ID No: 330)
```
ctaccttccttctagcagaaatg
```

Homo sapiens RAB3D, member RAS oncogene family (RAB3D):

(Seq ID No: 331)
```
cggcccttcctccgccttctgggcggagcccgcgcgggatccgggtggctg
caggctgctggcttctgcggctgcggggtcgggtcgcggccagggccaagccg
cagcgagttcacaggcggaaccctgcaggcggcgccctacgcgaggtcacccctgg
gaaggagcgcagcccacccggcccctccgcatccgagcaggac
gcccgtctcctccctgaggatttcaggtctccctgtcccaggaggcttgtgccaa
gatg
```

Homo sapiens ATP-binding cassette, sub-family B (MDR/TAP):

(Seq ID No: 332)
```
tcttctctcggttcctctttcctcgctcaagatg
```

Homo sapiens N-acylsphingosine amidohydrolase (acid
ceramidase) 1 (ASAH1):

(Seq ID No: 333)
```
ggctcttctttgcctctgctggagtccggggag
tggcgttggctgctagagcgatg
```

Homo sapiens cytochrome c oxidase subunit VIc (COX6C):

(Seq ID No: 334)
```
ttttcctttagtcaggaaggacgttggtgttgaggttagcatacgtatcaaggacag
taactaccatg
```

Homo sapiens COX15 homolog, cytochrome c oxidase assembly protein
(yeast) (COX15):

(Seq ID No: 335)
```
gcttctcttttccttggcggaggagggagac
cacagagccctgggttgtggaagaggtggctgttccctgtcatcagtatg
```

Homo sapiens c-src tyrosine kinase (CSK):

(Seq ID No: 336)
```
ccccttccccgccttcttccctccgcgacccgggccgtgcgtccgtcccctgcctc
tgcctggcggtccctcctccctctccttgcacccatacctctttgtaccg
cacccctgggaccctgcgccctcccctcccctgaccgcatggaccgtcccg
caggccgctgatgccgccgcggcgaggtggcccggaccgcagtgccccaaga
gagctctaatggtaccaagtgacaggttggctttactgtgactcggggac
gccagagctcctgagaagatg
```

Homo sapiens versican (VCAN):

(Seq ID No: 337)
```
gagcctttctggggaa
gaactccaggcgtgcggacgcaacagccgagaacattaggtgttgtggacaggagctgg
gaccaagatcttcggccagcccgcatcctcccgcatcttccagcaccgtcccg
cacccctccgcatccttccccgggccaccacgcttcctatgtgacccgcctgggcaac
gccgaacccagtcgcgcagcgctgcagtgaatttccccccaaactgcaataa
gccgccttccaaggccaagatg
```

Homo sapiens dystroglycan 1 (dystrophin-
associated glycoprotein 1) (DAG1):

(Seq ID No: 338)
```
gcgcctcttaggctt
ggcggtggcggcggcggcagcttcgcgccgaatcccggg
gagcggcggtggcggcgtcctggggccaggaggagcgaacac
ctgccgcggtcctcccgccggcgctgggctctgtgtgctccgggatggagcaggtgtg
cagagggtgagaacccagctctgggaccaagtcacttgcttccttacttagcaagac
tatcgacttgagcaaacttggacctgggatg
```

Homo sapiens DEAD (Asp-Glu-Ala-Asp) box helicase 5 (DDX5):

(Seq ID No: 339)
```
ccccctcttttggttacagacgtgagggctctttggagacgtaaacatctccgag
tggcgagggtgggcggggctgggcttgggaaagggcggggtggcttgcttgaggtgtg
gaaagaccagaagaaggtgaggtcaagagagtg
cagaatgaggcattccaatggtgggtgggccctgacctgagagagtggcgcggg
gagggtgaaagcgcggcgatcctggaacgccagcgggcgttgcggcc
tatgcgcgaggggcggggcgattaggtcatagagcggctcccagcgttccctgcggcg
taggaggcggtccagactataaaagcggctgccggaaagcggccggcac
ctcattcatttctaccggtctctagtagtg
cagcttcggctggtgtcatcggtgtccttcctccgctgccgccccg
caaggcttcgccgtcatcgaggccatttccagcgacttgtcgcacgcttttctata
tacttcgttccccgccaaccgcaaccattgacgccatg
```

*Homo sapiens* desmoplakin (DSP):

(Seq ID No: 340)

gctcctctgcgcccttgccgccctccgagccacagctttcctcccgctcctgcccccggcccgtcgccgtctccgcgctcgcagcggcctcgggagggcccaggtagcgagcagcgacctcgcgagccttccgcactcccgcccggttccccggccgtccgcctatccttggccccctccgctttctccgcgccggcccgcctcgcttatgcctcggcgctgagccgctctcccgattgcccgccgacatg

*Homo sapiens* glutamyl-prolyl-tRNA synthetase (EPRS):

(Seq ID No: 341)

cttcctttcgcggggtcctccgtagttctggcacgagccaggcgtactgacaggtggaccagcggactggtggagatg

*Homo sapiens* acyl-CoA synthetase long-chain family member 4 (ACSL4):

(Seq ID No: 342)

gctcctcctcgtcccagcgctagcgggcacgcggttcctttttgcgagctttccgagtgccaggcgccggccggctgcgaagacgcggtgggccgcccctccgattgaaatcacagaagatattcgtgttcttcttaagagaaaaagaggacattttagctttctcagttgaaggcgtactttattgtcggcttccaaagattactaactttatctgtatcactaagattgaactgcctggctgtactgctattcttactgctgcttctattattgccttcttcagcacaataaggcttcaaaagccaaagaataacaagaaataagcaccattttagaagcctttccactatg

*Homo sapiens* fibroblast activation protein, alpha (FAP):

(Seq ID No: 343)

tggtcctttcaacggttttcacagatccagtgacccacgctctgaagacagaattagctaactttcaaaaacatctggaaaaatg

*Homo sapiens* UDP-N-acetyl-alpha-D-galactosamine:polypeptide N-acetylgalactosaminyltransferase 3 (GalNAc-T3) (GALNT3):

(Seq ID No: 344)

ctgcctctccaggcaacgcgggaggcccagcgggaaggcaggaggcggcggcggaggagagctctactgagccgcaactgtggcgacagcaaccggagtcgcagccgccgccacctgcacctggcgcctagcccacgtccagcgcctgccggccgccgcttcccgccacccgccctgcccacccgccaggtactaccattaaagatacctcttctcagcaaatctatgataaaaaatataagtaacagaagaagaaataactgttatttgtcaagtgacaagcttttaatgtcagaatg

*Homo sapiens* glypican 3 (GPC3):

(Seq ID No: 345)

acgtctcttgctcctcagggccactgccaggcttgccgagtcctgggactgctctcgctccggctgccactctcccgcgctctcctagctccctgcgaagcaggatg

*Homo sapiens* interleukin enhancer binding factor 2, 45 kDa (ILF2):

(Seq ID No: 346)

acgcctcttcagttgtctgctactcagaggaaggggcggttggtgcggcctccattgttcgtgttttaaggcgccatg

*Homo sapiens* nucleosome assembly protein 1-like 1 (NAP1L1):

(Seq ID No: 347)

gggtctttttagcgccatctgctcgcggcgccgcctcctgctcctcccgctgctgctgccgctgccgccctgagtcactgcctgcgcagctccggccgcctggctccccatactagtcgccgatatttggagttcttacaacatg

*Homo sapiens* asparaginyl-tRNA synthetase (NARS):

(Seq ID No: 348)

cgctctctgatgcaacgccggaatcgcggaaaccgccggtgcacgttggagtcataagacggcgtcggtgttgcagtctgtgtccttggaggtgaccagggccactgcaggcatg

*Homo sapiens* NADH dehydrogenase (ubiquinone) 1 alpha subcomplex, 10, 42 kDa (NDUFA10):

(Seq ID No: 349)

cgtcccctt
gggtccttgatcctgagctgaccgggtagccatg

*Homo sapiens* NADH dehydrogenase (ubiquinone) Fe—S protein 2, 49 kDa (NADH-coenzyme Q reductase) (NDUFS2):

(Seq ID No: 350)

ttctccttcccgcagtctgcagccggagtaagatg

*Homo sapiens* NADH dehydrogenase (ubiquinone) Fe—S protein 5, 15 kDa (NADH-coenzyme Q reductase) (NDUFS5):

(Seq ID No: 351)

catccttttacggcaggcgtccgcgtcgctagctagtcgttctgaagcggcggccagagaagagtcaagggcacgagcatcgggtagccatg -continued

*Homo sapiens* phosphoenolpyruvate carboxykinase 2 (mitochondrial) (PCK2):

(Seq ID No: 352)

ccctccttttaa
gcgcctcccgccagcctctgctgtggctcgcttcgccgcgctccctccttcccgccttc
catacctccccggctccgctcggttcctggccaccccgcagcccctgcccaggtgccatg

*Homo sapiens* serpin peptidase inhibitor, clade B (ovalbumin), member 6 (SERPINB6):

(Seq ID No: 353)

ctcccttcgcgctccggacgggcgacgg
tagctcgagacccgggactccgcccgcctccccgcgagtattt
gaggtccggggcggctccggcgcctctgcccgccgttctgctcgctcgctccccgctctg
gagtctgccatcatg

*Homo sapiens* Rab geranylgeranyltransferase, alpha subunit (RABGGTA):

(Seq ID No: 354)

ttctctcctcagacttcaagggctaccactggacccttcccctgtctt
gaaccctgagccggcaccatg

*Homo sapiens* Rab geranylgeranyltransferase, beta subunit (RABGGTB):

(Seq ID No: 355)

ctctctcctttccctgttagacatg

*Homo sapiens* small nuclear ribonucleoprotein polypeptide A (SNRPA):

(Seq ID No: 356)

agttctctccgcacgcgggctggagaagcgggtcctacgcacgctttgtt
gtcgcgctttgcctccgtccttgcccctactcccgccttacctgacttccttttcggag
gaagatccttgagcagccgacgttgggacaaaggatttgga
gaaacccagggctaaagtcacgttttcctccttaagacttacctcaacacttcactc
catg

*Homo sapiens* sterol regulatory element binding transcription factor 2 (SREBF2):

(Seq ID No: 357)

cgcccttctgtgcggcgcccgggcgcaac
gcaaacatggcggcgggtggcacccgtcggtgaggcggtgccgggcgggggtt
gtcgggtgtcatgggcggtggcgacggcaccgcccccgcgtctccctgagcgggacgg
cagggggggcttctgcgctgagccgggcgatg

*Homo sapiens* translin (TSN):

(Seq ID No: 358)

ctgcccttggac
gcgcgcctcggttccgaacgcagcggacggcgcctcaggcagcgcggcg
gacagcccgtcctccggcgcgccgcgagcctcggaggaccctagcgacggtcgtggcg
taagaccggggggacgcggcggtagcggcggccgttgcgattgattgcgctggtt
gcctgcggcgtccacttccttggccgcccttgctacactggctgattgttgtg
cagccggcgccatg

*Homo sapiens* Fanconi anemia, complementation group G (FANCG):

(Seq ID No: 359)

ccacccttctcgaggctgtggcctccgcgagagccgagcgggccgcaccgccggccgtg
cgactgccccagtcagacacgacccccggcttctagcccgcctaagcctgtttggggttgc
tgactcgtttcctccccgagtttcccgcgggaactaactcttcaagaggaccaaccgcag
cccagagcttcgcagaccccggccaaccagaggcgaggttgagagcccggcgggccgcggg
gagagagcgtcccatctgtcctggaaagcctgggcggtggattgggaccccgagagaag
caggggagctcggcggggtgcagaagtgcccaggcccctccccgctgggggttgggagctt
gggcaggccagcttcacccttcctaagtccgcttctggtctccgggcccagcctcggcca
ccatg

*Homo sapiens* DEAD (Asp-Glu-Ala-Asp) box polypeptide 39B (DDX39B):

(Seq ID No: 360)

ttccctccttcgtcgctgtt
gctgccgccatacgcgctctccctgtttagctcttctgttagaaatagtatcttt
gttttcctttgctgttcctcaatcccctactcttcacccccttgttttcacctatttt
gcgagaaacccatccagatccccctttccctttcttcccctgccggcccagttatg

*Homo sapiens* RAB11A, member RAS oncogene family (RAB11A):

(Seq ID No: 361)

ccgcccttttcgctcctcggccgcgcaatg

*Homo sapiens* SPARC-like 1 (hevin) (SPARCL1):

(Seq ID No: 362)

agctcttccctttttggtttgcaagcactgcctgtaaagccctcgcatga
gaggccagcctgctagggaaatccaggaatctgcaacaaaaacgatgacagtctgaaa -continued

```
tactctctggtgccaacctccaaattctcgtctgtcacttcagaccccactagtt
gacagagcagcagaatttcaactccagtagacttgaatatgcctctgggcaaagaa
gcagagctaacgaggaaagggatttaaagagttttttcttgggtgttt
gtcaaacttttattccctgtctgtgtgcagaggggattcaacttcaattttctgcag
tggctctgggtccagcccttacttaaagatctggaaagcatg
```

*Homo sapiens* cyclin B2 (CCNB2):

(Seq ID No: 363)
```
ctccctttttcag
tccgcgtccctccctgggccgggctggcactcttgccttccccgtccctcatg
```

*Homo sapiens* cytochrome c oxidase subunit VIIa polypeptide 2 like (COX7A2L):

(Seq ID No: 364)
```
ggtccttctctggggcggtcgcgttggcagcggatgcgggaagc
cggactctgggcgtcatg
```

*Homo sapiens* lysophosphatidic acid receptor 2 (LPAR2):

(Seq ID No: 365)
```
cgccctctcagcaaccgcacagggcgcacccggacgctctaccgctcccgccgcag
tcgccgggccatgggcctcgagcccgccccgaaccccgcgagcccgcctt
gtctgcggcgtgactggaggcccagatg
```

*Homo sapiens* adaptor-related protein complex 4, mu 1 subunit (AP4M1):

(Seq ID No: 366)
```
cgttctttgttccggggccgcagggcgggg
caggcccgactttcgccgtcttcttgtctactctccagaacggccatg
```

*Homo sapiens* budding uninhibited by benzimidazoles 3 homolog (yeast) (BUB3):

(Seq ID No: 367)
```
cttcctctccgcctccttcgcctagcctgcgagtgttctgagggaagcaaggaggcggcg
gcggccgcagcgagtggcgagtagtggaaacgttgcttctgaggggagcccaagatg
```

*Homo sapiens* DEAD (Asp-Glu-Ala-Asp) box helicase 21 (DDX21):

(Seq ID No: 368)
```
ctacctcttcctctccacgcggttgagaagaccggtcggcctgggcaacctgcgctgaa
gatg
```

*Homo sapiens* solute carrier family 33 (acetyl-CoA transporter), member 1 (SLC33A1):

(Seq ID No: 369)
```
tgctctctgccgcatt
gatagcagcgagagctggaggtgttgggtcgggagaccagccgttcgatcccgccg
caggtaggagctggtttccatcctggcaccacggcacacac
ctccagcctcgagcccggcgctgctgcccggggtctccttcaggctctttgac
gccgttccaggggcacctatccaggcatcctctgggcctctagccagag
gactggctcccggcttcagcactccgggctgcagtaa
gaagtgcccttatcgctctgagccctgccaccatcccgtgaaccac
cgaaaccctggtccagcgcgacagccttggacctgggactggacggatccaaaac
gctcagcctcggccccccacagacggggctctgcatcgtctctgatatg
```

*Homo sapiens* G protein-coupled receptor 37 like 1 (GPR37L1):

(Seq ID No: 370)
```
tgctcttcctgggctggctgtctcctgctcatccagccatg
```

*Homo sapiens* neuronal regeneration related protein homolog (rat) (NREP):

(Seq ID No: 371)
```
ctgtctttctagcatgttgcccttttcaaccacattt
gtgtttcaggtgtagagaggagagagagtgaacagggagcggggcttttgtctgtt
ggtctccctggactgaagagagggagaatagaagcccaagactaagattctcaaaatg
```

*Homo sapiens* vesicle-associated membrane protein 3 (cellubrevin) (VAMP3):

(Seq ID No: 372)
```
gcttctctgctgaccctctctcgtcgccgctgccgccgccg
cagctgccaaaatg
```

*Homo sapiens* synaptosomal-associated protein, 29 kDa (SNAP29):

(Seq ID No: 373)
```
cctccttctgtttcccagaccgagagccgcgccggcaccatg
```

*Homo sapiens* lon peptidase 1, mitochondrial (LONP1):

(Seq ID No: 374)
```
cccctcttctccgcgtaggcccagctccctgaagcggctgtttcgagccac
gcgcccatcgggtaccgaggcacgcgccgggcgtcacgtgcgtttcgcggcgagcg
gaaatgacgcgagttgtgtgagccgccagtatggccgggctatg
```

-continued

*Homo sapiens* kinesin family member 3B (KIF3B):

(Seq ID No: 375)

ctgtctctccccatccggggcagcggg
gaatggctgagccaggggttcgccgccccgccgccgccgccgccgccgccgcc
gccgcccgcttcggctcgggcctcaggaccgtagcatcctgagacatttgaatt
gacacttctcaagatttgactggatcagagttcatcatg

*Homo sapiens* transmembrane 9 superfamily member 2 (TM9SF2):

(Seq ID No: 376)

cttcctttatctctggcggccttgtagtcgtctccgagactccccaccctcttccctc
ttgacccccaggtttgattgccctttccccgaaacaactatcatg

*Homo sapiens* cytosolic iron-sulfur protein assembly 1 (CIAO1):

(Seq ID No: 377)

gagcctctgtcggccgcggaagcctggagtgggcggtacgcagac
gcgcgcggtgagacccgctgtctgctcagcggactctgcccgcccccac
ctcccctgcgtcgggccgacatg

*Homo sapiens* GRB2-related adaptor protein 2 (GRAP2):

(Seq ID No: 378)

caccctctttcagagtggtacatggaagacagcacaaagtg
gatccatactctgaaatgcagtaactctgatgcttgaatttgtctcccttctt
gccagaaaggattctaataactcggtgtcaaagccaaga
cataaactcaacccttctcttccaaaagcttcacgttacagcatg

*Homo sapiens* leupaxin (LPXN):

(Seq ID No: 379)

gtacctttctcggggtgtctgcg
taactgcccagacttgccttggtttggtcagatgacacctcctctgg
gactggctagccagcgttcatg

*Homo sapiens* SH3-domain binding protein 5 (BTK-associated) (SH3BP5):

(Seq ID No: 380)

tttcctctgctccgccgcggccggaggtatccg
catcggcgagctgcgtctcccgggtgtcggccccggcggctcccgac
cgtgcccggctgtggcgaggcggctccagcccagcctgtgg
cagccgcgaccccgggggcgctccggagcccactgcgcggcgcgcgtgccggctgcctg
catg

*Homo sapiens* phosphatidylinositol glycan anchor biosynthesis, class B (PIGB):

(Seq ID No: 381)

ctttcttccgccttaggaaggtggcggccagggatg

*Homo sapiens* lipopolysaccharide-induced TNF factor (LITAF):

(Seq ID No: 382)

cggcccttttctcggggcgcccgagaggccagctcagacctcccggctcgacaggcggcg
cgggcggcggtgagtgcggcgcggggacgccggggcgcggggaccagcgggagacagcgg
ggggccggtggcgccagcacctgctgggggcccccgggcactgagcccttggctggggcct
cctgggatgccaggggcgcgggtcggtcgcgggcatcgaggcgcggcggagggcgtgg
gggcccggccggggcggggtccggcctcccagcgctggtcccggccgcgtctccggttgg
gttcagctcctgcgtcccagagtggcccgatcgcgcgtggcggggtcgtccggcccccac
ccgaacgagcgcccttcgcggccgccgcgtcccctccccggagaggacgggccctggg
cttttagaaaaggcgcgattctctctagtgactcaggttgagatttccagaaatatcc
cccggggggttcagaaacaaaaccaaaacaaacaaaaaaacccaacgaattcccaaatgc
tatttgccaaacatttgacttctaggggcgcgggtacccgcgtttctctcctgcccccg
cgacttcgcgcaagatccgggaaggacacccgaggcccctgggagaccctggggaggtga
aaatcagagagcgaagcgggccgtggcccctaggcctgaccctccccgcggggtaaggc
gggcaccccgcgagcgcaggggtcctcttactgctgatggcacccagctctgggcccaga
cgccgctcaccgtccaccgccggtgctgggtaaaatg

*Homo sapiens* etoposide induced 2.4 mRNA (EI24):

(Seq ID No: 383)

ccaccccttcggctctgggccccgcctcgtggtgccggctggttcttcgcgctcgcccga
cttcccagcggcccgtgcggcccgggcatgcccagtgcgggcg
cagcggccccggcccctggaagcgccccggcggagctggcctgcggtgggctagggg
cagggccggagccgcgcggcggagctgtggatccttcatgatgagagatttggg
gacacttctctctcctgtgtgtagttgatagtttggtggtgaagagatg

*Homo sapiens* chromosome 14 open reading frame 2 (C14orf2):

(Seq ID No: 384)

tgaccttccgagttggctgcagattt
gtggtgcgttctgagccgtctgtcctgcgccaagatg

*Homo sapiens* peroxiredoxin 6 (PRDX6):

(Seq ID No: 385)

attcctccgcgcgctgg
gacaggctgcttcttcgccagaaccaaccggttgctt
gctgtcccagcggcgcccccctcatcaccgtcgccatg -continued

*Homo sapiens* solute carrier family 29 (nucleoside transporters), member 1 (SLC29A1):

(Seq ID No: 386)
ctctcttccgcccggcggcccacac
cggtcaggcccggcgcgggctgcgctctccagctgtggctatggccccagcccga
gatgaggagggagagaactaggggcccgcaggcctgggaatttccgtcccccac
caagtccggatgctcactccaaagtctcag
caggcccctgagggagggagctgtcagccagggaaaaccgagaacaccatcaccatg

*Homo sapiens* heterogeneous nuclear ribonucleoprotein F (HNRNPF):

(Seq ID No: 387)
cgaccttcctgccgggccggcggtccgaggctgctggagtgccgtgag
caggccgcgggaacgtcgccgtcacctt
gtctcggggcctcggcgctgcttcccgccaaaacacgtttac
cgcgcgcccgggcctcccaccttgcggaagggaccccaccaccacttggatttctgtt
gcaggttgagaacaaaaacatgcacctggagtttccccggagccctctgcgtggtt
gagcttcggtggaatttcggggctcttggctgccagccgcgcttgcctggtag
caacagaaaccagtcctgctcgcctccgtggacatttcattac
catccagaagtgtctcccactgaaggcatccgtggttgtttttaagccacaaaaaa
gccacacccaagatcacctgacacccaccctgacaagtgtccatg

*Homo sapiens* islet cell autoantigen 1, 69 kDa (ICA1):

(Seq ID No: 388)
ccgcccctttccctcgccttcggctgacgctgacgtcggatgagtgatccggagggac
gctccgaccgcggccgggaggctcctgggggccggggctccgaggttataa
tataacttatcctctcatgcttttttcctgccccttctccccaaatcatcaacaa
tagaagaagaagaaaacatg

*Homo sapiens* PWP2 periodic tryptophan protein homolog (yeast) (PWP2):

(Seq ID No: 389)
gtgtctctgtgggcggccgccgggttgagctgcggcacacgtg
cgacggccgtgatg

*Homo sapiens* glutaminyl-tRNA synthetase (QARS):

(Seq ID No: 390)
gtttcttttag
tttccggtgtctctgcaatg

*Homo sapiens* stearoyl-CoA desaturase (delta-9-desaturase) (SCD):

(Seq ID No: 391)
cggcctctgtctcctcccctcccgcccttacctccacgcgggac
cgcccgcgccagtcaactcctcgcactttgcccctgcttggcagcgga
taaaagggggctgaggaaataccggacacggtcaccgtt
gccagctctagcctttaaattcccggctcggggacctccacgcac
cgcggctagcgccgacaaccagctagcgtgcaaggcgccgcggctcagcgcgtac
cggcgggcttcgaaaccgcagtcctccggcgaccccgaactccgctccg
gagcctcagccccctggaaagtgatcccggcatccgagagccaagatg

*Homo sapiens* fragile X mental retardation, autosomal homolog 1 (FXR1):

(Seq ID No: 392)
cggcctttgcggttccaacatg

*Homo sapiens* musculin (MSC):

(Seq ID No: 393)
tagccttttcaaaaggcgcagcttac
cgcggtgcgcgcggattctggacttgggcgccaactcgtagtccac
gctcccggggtcagcagaggggcgctcacgctctcgccacccac
ctcgctttctcaccccgcgcttcccggcctgggttttagtcttcctt
ggagcgctctctggcctccgcctccgccagggagcggaaggcggagacagcga
gactggccagggggaggaaagaggacgcgtgtgggcaaggggacaacgggatg

*Homo sapiens* RNA binding motif protein 8A (RBM8A):

(Seq ID No: 394)
cgacctttcccctctgcgacagtttcccgaggtacctagtgtctgagcggca
cagacgagatctcgatcgaaggcgagatg

*Homo sapiens* heparan sulfate (glucosamine) 3-O-sulfotransferase 1 (HS3ST1):

(Seq ID No: 395)
ggtcctctgcgccctgg
cagccaggagtcgccgccacgaccgccgggtctcag
tgggtgcctgcgccttctcccgcccgcctgccccgggccatccagaaacttgctc
tacccgcgcgggtgctcggcagtgctgcccatggcccagcccaggagcc
tatttagggcgccgacgggctggacagaggcgcggctcagtaattgaaggcctgaaac
gcccatgtgccactgactaggaggcttccctgctgcggcac
ttcatgacccagcggcgcgcgggcccagtgaagccaccgtggtgtccagcatg -continued

*Homo sapiens* solute carrier family 12 (potassium/
chloride transporters), member 6 (SLC12A6):

(Seq ID No: 396)

ctgtctctt
gtaggcagggatcacagtctgaaacgacagcaaggaa
gaggtaggcagggaaaactaactggaaggaagtttaaatacagaaagag
caaagtattatctaactataacaatg

*Homo sapiens* apelin receptor (APLNR):

(Seq ID No: 397)

cttcctccagggtctgga
gaacccagaggcagctcctcctgagtgctgggaaggactctggg
catcttcagcccttcttactctctgaggctcaagccagaaattcaggctgcttgcagag
tgggtgacagagccacggagctggtgtccctgggaccctctgcccgtcttctctccac
tccccagcatg

*Homo sapiens* calpain 1, (mu/I) large subunit (CAPN1):

(Seq ID No: 398)

cgctcttcctggttgggccctgccctgagctgccaccgggaagccagcctcagggactgc
agcgaccccaaacacccctcccccaggatg

*Homo sapiens* cyclin C (CCNC):

(Seq ID No: 399)

cttcctttcgccgtcgccgccgcggagcg
gagtcgagccgagctgatttgatcgaggagcgcggttaccggacgggctgggtc
tatggtcgctccgcgggccgctccgccggctggtgcttttttatcagggcaa
gctgtgttccatg

*Homo sapiens* glutamate dehydrogenase 1 (GLUD1):

(Seq ID No: 400)

cttcctccctagtcgcggggagtctgagaaagcgcgcctgtttcgcgaccatcacgcac
ctcccctccgcttgtggccatg

*Homo sapiens* guanine nucleotide binding protein-like 1
(GNL1):

(Seq ID No: 401)

cctccttcctcgccgccggggcgccctctcggtgccactggctctcac
gtgccagtagcccaccccgcatcatcctctcgcctcgctcctggagggaagtgacta
tatctcccccgtccgccttccatcgccgcgcggcgg
taattctgtcgggcccgcccgctgacgtcac
ctgctagccccgcctcctctagggtcccgggcccctgcggcgggggctgccccgggggg
cagtcagttgaggcggcggagctcggcggagggcgggccaggtgactggtccgggc
catg

*Homo sapiens* lysophosphatidic acid receptor 4 (LPAR4):

(Seq ID No: 402)

aggccttttgtgtcctgtttgctaaaggcatgcgggctacagcattcaagagagggag
tcgttaacaaagggaaagagataaatgtaaataa
gctcacatttacagaatgagcggtttgcagtaaaaagctgcggcagcccagagtctgc
tactttaggctgggctaacctttccctg
taaaaaaaaaaaaaaaaaaaaaaaaaaaaaaatggataaaaatatgcac
ttccaaagggcgagttgcccatttacatgtttattagctaattatctacaggcatcag
cacattctctcatctagcacactctttcttggggaggaaaatatttcctaccggtcca
tagtgtcagagtggtgaaccctgcagccagcaggcctcctgaaaaaaaagtccatg

*Homo sapiens* G protein-coupled receptor kinase 5 (GRK5):

(Seq ID No: 403)

gctcctctttgcagagggggaaactcttgggctgagagcaggaataatgcgg
taggcaaggcgggctgctggctccccccggctccggcagcagcggcggcagcccgag
cagcggcagcagcagcggcagcacccccaggcgctgacagccccgccggccggctccgtt
gctgaccgccgactgtcaatg

*Homo sapiens* glutamic-pyruvate transaminase (alanine
aminotransferase) (GPT):

(Seq ID No: 404)

agcccttctgtccctcccag
tgaggccagctgcggtgaagagggtgctctcttgcctggagttccctctgctac
ggctgccccctcccagcccctgggcccactaagccagacccagctgtcgccattccac
ttctggtcctgccacctcctgagctgccttcccgcctggtctgggtagagtcatg

*Homo sapiens* hydroxyacyl-CoA dehydrogenase (HADH):

(Seq ID No: 405)

gggtctcctcgctgtcgccgccgctgccacaccatg

*Homo sapiens* high density lipoprotein binding protein
(HDLBP):

(Seq ID No: 406)

tcttctcctttaccaagatggcggcttgtccctgtttcgccacagttcctaccttatgag
ctcggttttcttatgcttataagagtggaacagcaaaagctgg -continued
caggctgacagaggcggcctcaggacggacctrctggctactgaccgtttt
gctgtggttttcccggattgtgtgtaggtgtgagatcaaccatg

*Homo sapiens* histidine triad nucleotide binding protein 1
(HINT1):

(Seq ID No: 407)

gttcctcccttcttccgagcctctcctctggccgccgcgcgggagagagg
ccgagatg

*Homo sapiens* heat shock 70 kDa protein 1A (HSPA1A):

(Seq ID No: 408)

ctaccttttcgagagtgactcccgttgtcccaaggcttcccagagcgaacctgtg
cggctgcaggcaccggcgcgtcgagtttccggcgtccggaaggaccgagctcttctcgcg
gatccagtgttccgtttccagcccccaatctcagagcggagccgacagagag
cagggaaccggcatg

*Homo sapiens* nucleolin (NCL):

(Seq ID No: 409)

cagtctttcgcctcag
tctcgagctctcgctggccttcgggtgtacgtgctccgggatcttcag
cacccgcggccgccatcgccgtcgcttggcttcttctggactcatctgcgccactt
gtccgcttcacactccgccgccatcatg

*Homo sapiens* nuclear factor, interleukin 3 regulated
(NFIL3):

(Seq ID No: 410)

ccgccccttcttctcctcgccggcccgagagcaggaacacgataac
gaaggaggcccaacttcattcaataaggagcctgacggatttatcccagacgg
tagaacaaaaggaagaatattgatggattttaaaccagagtttttaaagagcttgagaa
tacggggaaattaatttgttctcctacacacatagatagggtaaggttgtttctgatg

*Homo sapiens* protein phosphatase 1, regulatory subunit 3C
(PPP1R3C):

(Seq ID No: 411)

cagtctctcccagcgaccgccgcgggggcaaggcctg
gagctgtggttcgaatttgtg
caggcagcgggtgctggcttttagggtccgccgcctctctgcctaatg

*Homo sapiens* protein tyrosine phosphatase, non-receptor type
14 (PTPN14):

(Seq ID No: 412)

agttctttccaacttttctcggcggagtgagcgcagcgggcgcagactcgggggcaggt
tgctgtgcttcttccgggctcagccgcctgctctcctggctcaggtcctcggggagccta
gacagacatcaagtggccactggcgctccttcccctcccagctgagccatcctcccggc
ctcctcgggcgggacagccccgtgcttaggttttctcctttctccccggtgcgcctc
tgctcggactctcgcgccgggatcgcggcggaaacctccctccccttcgcctcctgcgg
ctccttcccttcgcccctcctccgccagtcactgaatcaattccgtggggaatcggctc
cgccgccgcgaaggacagcctttccgcgcgggactccggggcgccacggggccatgtaa
gcagctatcttccagagggccacactgggcatggacacccttttccctgcctggaggagc
acaggtgatagtgtaattttccagtcacgaaactgctaaggccatctcaggggcgtgtgc
gccaggataggcgggcggcgtccgaggaccacatagccatg

*Homo sapiens* selenoprotein P, plasma, 1 (SEPP1):

(Seq ID No: 413)

cttttcttttaagttgataacaatcagctcaggggtttgctctgcttgcaaggtcactgca
agaatgaacattgaactttggactatacctgaggggtgaggtaaacaacaggactataaa
tatcagagtgtgctgctgtggctttgtggagctgccagagtaaagcaaaga
gaaaggaagcaggcccgttggaagtggttgtgacaacccagcaatg

*Homo sapiens* serine hydroxymethyltransferase 2 (mitochondrial)
(SHMT2):

(Seq ID No: 414)

agctcttctcgcgcatgcgttctccgaac
ggtcttcttccgacagcttgctgccctagaccagagttggtggctggac
ctcctgcgacttccgagttgcgatg

*Homo sapiens* tyrosine kinase with immunoglobulin-like and EGF-
like domains 1 (TIE1):

(Seq ID No: 415)

tttcctcttcctccccagcaccgacccacactgac
caacacaggctgagcagtcaggcccacag
catctgaccccaggcccagctcgtcctggctggcctgggtcggcctctggagtatg

*Homo sapiens* coiled-coil domain containing 6 (CCDC6):

(Seq ID No: 416)

cctcctttcccccagcccgccgcggccatg

*Homo sapiens* nuclear receptor coactivator 4 (NCOA4):

(Seq ID No: 417)

ggacctttcgcactcgggtcaggggtaaagcagcctgtcgcttgccgggcagc
tggtgagtcggtgacctggcctgtgaggagcagtgaggagaatg

*Homo sapiens* chromatin assembly factor 1, subunit B (p60) (CHAF1B):

(Seq ID No: 418)

gtgcctctgactgtccgggtccctccagcattttt
gcagctttctcctgtcttgaagaagtagaacggtgcccgagaaac
gttttttcccccttcgagactcaggaggatgaaagtcatcacttgtgaaatagcctgg
cacaacaaggagcccgtgtacagcctggacttccagcatg

*Homo sapiens* 3'-phosphoadenosine 5'-phosphosulfate synthase 1 (PAPSS1):

(Seq ID No: 419)

agccccgccccgctcgctggcctgccctcctcttgctaccctcccggcg
cagagaaccccggctgctcagcgcgctccgcggtcatg

*Homo sapiens* Fas apoptotic inhibitory molecule 3 (FAIM3):

(Seq ID No: 420)

tgccctcctcttgctaccctcccggcgcaga
gaaccccggctgctcagcgcgctccgcggtcatg

*Homo sapiens* N-acetylated alpha-linked acidic dipeptidase 2 (NAALAD2):

(Seq ID No: 421)

cagcctcctgccagcgcgctctctgtttctctgcagccccgaa
gctcgcgaatgtagcaggcgccccaagctcggtcctcaagaagccatggcg
gaatccaggggccgtctgtaccttggatgtgcttggctgctgcgctgg
catctttcctgatgggatttatggtgggtaagt

*Homo sapiens* abl-interactor 1 (ABI1):

(Seq ID No: 422)

ctgtctctttaacgcgagag
gaagcgatgcagaggggtggaaaatg

*Homo sapiens* potassium voltage-gated channel, Isk-related family, member 3 (KCNE3):

(Seq ID No: 423)

cttccttttctgccttctctcctgctttctagctctgggctttcccagctccgaagtcaa
tactgagatcccagatgtgtccagagacatcctgaagaggctcgggggtggag
gagccttagtgtgtccacaaagggactcctgaaactgactgagagccagt

*Homo sapiens* target of myb1 (chicken)-like 1 (TOM1L1):

(Seq ID No: 424)

ggccctctggcgctaccatg

*Homo sapiens* ubiquitin-like modifier activating enzyme 2 (UBA2):

(Seq ID No: 425)

cgcccttcccccacccgcttccggccgcggctcggttctcccgcctccgcctccgccgcg
gctcgtggttgtcccgccatg

*Homo sapiens* scavenger receptor class B, member 2 (SCARB2):

(Seq ID No: 426)

ctccctccttgcagttggatccctggcgggtgcggcccggcccggcccgtgagcggcg
cacagaatg

*Homo sapiens* insulin induced gene 1 (INSIG1):

(Seq ID No: 427)

actcctcctttccccgccccgcctccgttcgga
gagccggcgggcgggcgcctctcggccaggaagcgcctcttggacgcgtgtgaccgatg

*Homo sapiens* kinesin family member C3 (KIFC3):

(Seq ID No: 428)

aggcctcttctgaggctctaggtgccccagtagcagggccttctgcagcaaggccgg
gaactgctgcaccattggtgtgtttaccttaagggactccaggcagcttccttgctgg
gaagatattcatttgctggggtggggctgggggtgcagaggtaggaagtgctgtggcta
gaaggcggcctggccagcgagtaggtggtggagcgagtgagagcgtgtgcgctg
taaacagtgtgagtgcatg

*Homo sapiens* LIM domain kinase 2 (LIMK2):

(Seq ID No: 429)

aggcctcttctgaggctctaggtgccccagtagcagggccttctgcagcaaggccgggaa
ctgctgcaccattggtgtgttttaccttaagggactccaggcagcttccttgctgggaag
atattcatttgctggggtggggctgggggtgcagaggtaggaagtgctgtggctagaagg
cggcctggccagcgagtaggtggtggagcgagtgagagcgtgtgcgctgtaaacagtgtg
agtgcatgtgcgccagcgcgtgcaaggacacggtaagggatgtacatgtattgtctcgtg
agtaagagcttgtgtgtgtgttgggatgggaagacacgtactggtatgagagcccgctg
agaagtgtatgtgtgagtactcgcgtggaagttttgcactcgggtttgaggctgtgcaaa
agtacgcatggctcaccaggtgtgggctgtgtgggctgcctcgtgtgtgccagcccgtg
tgcaggcctgttttgtgagagccttcagggaacgcatgagcacgtgtgccagtgcgagtg
cgggacgcggggaggcgggagagaccgagtgggaggccccgcgaaggagtgggagtggga
gtgggagtgccggcgggagacctgcgggggcgcgcccgggctgacgcgtgcgcgccagtg -continued

```
cgcgtgagtgcgggcgcgcgccgccgcccccgccggggtcggagccggttgccatggga
acgcgccgcggcccgagttaatcatttcctgtgtgaaagtgtgcgggaggggcgcgagcgg
gctggccgaggaggaggcggcggcgtggagctgcctcctgccggcgggccgggccgggcc
gagccccgggcgctgcggcgacgcctggatcctgcctccgccaggccggctgcctggtgc
cccgaggaggctgctgagcccaggccatg
```

Homo sapiens lectin, mannose-binding, 1 (LMAN1):

(Seq ID No: 430)

```
cctcctccgcgttccagaatccaagatg
```

Homo sapiens MRE11 meiotic recombination 11 homolog A
(S. cerevisiae) (MRE11A):

(Seq ID No: 431)

```
cgttctctcccgcggaattcaggtttac
ggccctgcgggttctcagaggcaagttcagaccgtgttgttttcttttcac
ggatcctgcccttcttcccgaaaagaagacagcctt
gggtcgcgattgtgggcttcgaagagtccagcagtgggaatttctagaattt
ggaatcgagtgcattttctgacatttgagtacagtacccaggggttcttggagaagaac
ctggtcccagaggagcttgactgaccataaaaatg
```

Homo sapiens nascent polypeptide-associated complex alpha subunit
(NACA):

(Seq ID No: 432)

```
cttccttctgcaacaggcgtgggtcac
gctctcgctcggtctttctgccgccatcttggttccgcgttccctgcacag
taagtactttctgtgccgctactgtctatccgcagccatccgcctttctttcgggctaa
gccgccccggggactgagagttaaggagagttggaggctttactgggccacagggttcc
tactcgcccctgggcctccggacaaaatgggtctgcggttggtgtcctggcaaaa
gcagggtagaagggctgcggggcgggcccagaatccgagcctgcagagatgggagcag
ttgcagtgttgagggcggaagaggagtgcgtcttgttttgggaactgcttcacag
gatccagaaaaggaaatg
```

Homo sapiens claudin 11 (CLDN11):

(Seq ID No: 433)

```
cgcccttcgccgctgagctcg
cagcctccggcgcccacctccacctccag
tgtcccgcctcgggccgtcgccctccagcggctcgcgagcgtgggagacgtacctggg
caggcactgtccagcccaggcccaggcacagccgtgaggggcgaggcacggg
gacatcctggcggccaccatg
```

Homo sapiens retinoblastoma binding protein 4 (RBBP4):

(Seq ID No: 434)

```
ccgcccctcccgcaacgctcgaccccaggattccccggctcgcctgcccgccatg
```

Homo sapiens acyl-CoA synthetase medium-chain family member 3
(ACSM3):

(Seq ID No: 435)

```
ccctcttctttagactgccacgaggaaaaagcagatgtga
gaactcaaggttcagggctgctcttctaagaaacaagtctgcca
taatctccatctgtgttggaatctgttaactaatgaactggtctctgtg
caaatcctgagtgctaaagcttccaacaagactgatg
```

Homo sapiens syndecan binding protein (syntenin) (SDCBP):

(Seq ID No: 436)

```
cgctctcttacactcgggcctcagaagtccgtgccagtgaccg
gaggcggcggcggcgagcggttccttgtgggctagaagaatcctgcaaaaatg
```

Homo sapiens serum/glucocorticoid regulated kinase 1 (SGK1):

(Seq ID No: 437)

```
agtccttctcattccttgccccgcccaaggctctcttcaccttccccgcggggtcctc
tcgttttctgtctcccaaatgctggcttcccgccttttcctccccccgcttatttacttaat
taaggccctgggctgcaccccaccggcagctccttcggggtgtggccgaagagctccg
agggcggggctgaccgagccatattcgggcgtggccggtggtgattggtgagggcgggc
ctgccgcaggggcggggcctgcaggtttggccccgcagggagcgcagctggcgccgct
gggagctggtggcgcggcgcaggtcccggccgagtgtggcgcagcagtggcggcgcttcc
cattcgccatgcgccggggtgggtgcccgaaggttgcatgatggaatttgaacattact
tcaagaggttttgtattttggattagttaattgggtttgtcctctgctgactgtttcttc
ggatgcatttttggtgtgctcttgagggattaaatg
```

Homo sapiens Wolf-Hirschhorn syndrome candidate 2 (WHSC2):

(Seq ID No: 438)

```
cgtccttccggctctcggctttgccacaaagcttcccgaagacgcggccgctacccgga
gacgcggtcgccacccagaagcgctctcccgggaagcccgctcgtgggaccgcgccac
ctgccgccgcctctgcgggcccgcagcccgacgggcgccgccatgtt
gggggtcctagcgagggacgcgtaggtgtcttcataagatg
```

Homo sapiens nuclear receptor subfamily 1, group H, member 3
(NR1H3):

(Seq ID No: 439)

```
cagtccttttgcaagagctgctaagagcgctgggtaaggagaggaaggg
gagagacatggaacttggctggtctgcagggaaatgccactgttttggccggag
```

-continued

```
taggggcgggagtggcgggagagggggtggccggctggggaggagccagcctggtgga
gaagctgccctgtgggcggggtgaggaggggagggctgtggtcaccaggcag
gaaggaggggtggcctgaccctcggcagtccctcccctcagcctttccccaaattgc
tacttctctgggctccaggtcctgcttgtgctcagctcagctcactggctggccac
cgagacttctggacaggaaactgcaccatcctcttctcccagcaaggggctccaga
gactgcccaccaggaagtctggtggcctggggatttggtgggtctgctccttag
```

*Homo sapiens* glypican 6 (GPC6):

(Seq ID No: 440)
```
cctcctttctccttccctctt
gcctccagtgactgtctccaggatttctctcttcctatttcaggag
gactctcacaggctcccacagcctgtgttaagctgaggtttccctagatctcg
tatatccccaacacataccctccacgcacacacatccccaagaacctcgagctcacac
caacagacacacgcgcgcatacacactcgctctcgcttgtccatctccctcccgggg
gagccggcgcgcgctcccacctttgccgcacactccggcgagccgagcccg
cagcgctccaggattctgcggctcggaactcg
gattgcagctctgaaccccatggtggttttttaaacac
ttcttttccttctcttcctcgttttgattgcaccgtttccatctgggggctagaggag
caaggcagcagcctcccagccagccttgttggctt
gccatcgtccatctggcttataaaagtttgctgagcgcag
tccagagggctgcgctgctcgtcccctcggctggcagaagggggtgacgctggg
cagcggcgaggagcgcgccgctgcctctggcgggctttcggcttgaggggcaaggtgaa
gagcgcaccggccgtggggtttaccgagctggatttgtatgttgcaccatg
```

*Homo sapiens* peptidylprolyl isomerase F (PPIF):

(Seq ID No: 441)
```
cggccttctgggcgcgcgcgacgtcagtttgag
ttctgtgttctccccgcccgtgtcccgcccgacccgcgcccgcgatg
```

*Homo sapiens* ARP1 actin-related protein 1 homolog A, centractin alpha (yeast) (ACTR1A):

(Seq ID No: 442)
```
agttccttccccagaaggaga
gattcctctgccatg
```

*Homo sapiens* tripartite motif containing 28 (TRIM28):

(Seq ID No: 443)
```
ggctctttctgcgagcgggcgcgcgggcgagcggttgtgcttgtgctt
gtggcgcgtggtgcggtttcggcggcggctgaggaagaagcgcgggcggcgccttcgg
gaggcgagcaggcagcagttggccgtgccgtagcagcgtcccgcgcgcggcggg
cagcggcccaggaggcgcgtggcggcgctcggcctcgcggcggcggcggcgg
cagcggcccagcagtt
ggcggcgagcgcgtctgcgcctgcgcggcgggccccgcgcccctcctccccccctgggcg
cccccggcggcgtgtgaatg
```

*Homo sapiens* aminoadipate-semialdehyde synthase (AASS):

(Seq ID No: 444)
```
cggccttccatcccagtttcttctaggaattcggagcctcccctgcagcgactcggaa
gattcgaggcggcggggacaagtcggcgcccagagcggacgagtcaccaggtgtcaa
gatg
```

*Homo sapiens* cornichon homolog (*Drosophila*) (CNIH):

(Seq ID No: 445)
```
ccgcctttctccgctggcaacggcgccgctccccgctcctcctcccagccatg
```

*Homo sapiens* M-phase phosphoprotein 10
(U3 small nucleolar ribonucleoprotein) (MPHOSPH10):

(Seq ID No: 446)
```
ctcccttcccttgcatgctgcattgtgtcgggagttgctgacagccatg
```

*Homo sapiens* ubiquitin specific peptidase like 1 (USPL1):

(Seq ID No: 447)
```
ccgccttcctagtggagacgcgagtgggggaggagcagtccgaggggaacgtgggtt
gaacgttgcaactagggtggagatcaagctggaacaggagttccgatcgacccggtac
caagaaggggagtgcccgcggcagggttcattgaaaaaatccttagtga
tattgacatgtctcaagtgacataaattagccaatgactcggaatg
```

*Homo sapiens* solute carrier family 23 (nucleobase transporters), member 1 (SLC23A1):

(Seq ID No: 448)
```
tggccttt
gtcaagtcatcccctcttctcctcaggaactgctcaaacctgtgccccaaagatg
```

*Homo sapiens* splicing factor 3b, subunit 4, 49 kDa (SF3B4):

(Seq ID No: 449)
```
ggatctctttcgccatg
```

-continued

*Homo sapiens* DnaJ (Hsp40) homolog, subfamily A, member 2
(DNAJA2):

(Seq ID No: 450)

ctgtctccctcggcctgtgccgccgcgacgccgctt
gtgggcccgactccgctctgtctgcttcgccaccttctccccgagcac
tgcccggccggccgccatg

*Homo sapiens* calicin (CCIN):

(Seq ID No: 451)

catcctctcttccaccctctcttctccctggtcaaccgctctgcaaacaac
catcaatctgatcccacaggcctgagaaagtctgctctccagtac
ctgctgctgatctgtttcagccgacaagaggcaccatg

*Homo sapiens* mannosidase, beta A, lysosomal (MANBA):

(Seq ID No: 452)

ctgcctttcgatctctccacatctcggtggcgcgggatctcaagatg

*Homo sapiens* microtubule-associated protein 1B (MAP1B):

(Seq ID No: 453)

aatcctttctcctgccgcagtggagaggagcggccggagcgagacac
ttcgccgaggcacagcagccggcaggatg

*Homo sapiens* malate dehydrogenase 1, NAD (soluble) (MDH1):

(Seq ID No: 454)

gagcctttctcgctaacaccgctcgccctctccgagtcagttccgcgggtagaggtgac
ctgactctctgaggctcattttgcagttgttgaaattgtccccgcagttttcaatcatg

*Homo sapiens* microfibrillar-associated protein 1 (MFAP1):

(Seq ID No: 455)

gtttctctatcagtcgcgcagctgtgttcgcggactcaggtg
gaaggaatttcttctcttcgttgacgttgctggtgttcactgtttggaattag
tcaagtttcgggaatcaccgtcgctgccatcaacatg

*Homo sapiens* chaperonin containing TCP1, subunit 3 (gamma)
(CCT3):

(Seq ID No: 456)

ggttctctctctccagaaggttctgccggttcccccagctctggg
tacccggctctgcatcgcgtcgccatg

*Homo sapiens* tubulin, alpha 1a (TUBA1A):

(Seq ID No: 457)

caacctctcctcttcgtctccgccatcagctcggcagtcgcgaagcagc
aaccatg

*Homo sapiens* CD164 molecule, sialomucin (CD164):

(Seq ID No: 458)

cttctctcccgaacgccagcgctgaggacacgatg

*Homo sapiens* cysteine-rich secretory protein 3 (CRISP3):

(Seq ID No: 459)

ctctctctgcaccttccttctgtcaatagatg

*Homo sapiens* SMYD family member 5 (SMYD5):

(Seq ID No: 460)

cggcctccatgtgcgac
gtgttctccttctgcgtgggcgtggcgggccgcgcgcgggtctccgtg
gaagtccgtttcgtgagcagcgccaaggtgaggtcggggcgggtcctgccgg
gagcctctccccagtccggccatg

*Homo sapiens* kelch repeat and BTB (POZ) domain containing 10
(KBTBD10):

(Seq ID No: 461)

ctgccttttacagctagacctgtgtgctg
caaggagctaaggccttcagtgtccccttccttacccaggtttctcacagaatg

*Homo sapiens* aldo-keto reductase family 1, member A1 (aldehyde
reductase) (AKR1A1):

(Seq ID No: 462)

ccgccccttgcaccgcccacgtggccagcgccacctgcctcattgtgcccaggagttctc
caaacccgcgctgcggagtgagtgaccaagttccggccagttcgacctcgaggatccaga
ggtggagacggtactacctcccagctctgttttccatcccttcaggtccttcctcggga
ggcggcgaaggcggtccaccctgcgcgtgatcctttatgccggccctgccctccctc
cgggtgaacttccccctcaccgccagacttaagctgaggatcgttggatctctggcggg
gtgcagaactgagcccaggccacagtaccctattcacgctctgtgcttgtgccaaggttt
caagtgatcctcccgcctcagcctgccaggtgctgagattacatgtatgagccactgca
cctgaaaggagccagaaatgtgaagtgctagctgaaggatgagcagcagctagccaggc
aaaggggggcaatg

*Homo sapiens* TRK-fused gene (TFG):

(Seq ID No: 463)

tgttcttccccacctgccac
gtacagagcccaagttctcgctaggcttgtt
gggtcagcgcgattggccggggcccgcgcgagcctgcgagcgaggtgcggcggtcgcgaa
gggcaaccgaggggccgtgaccaccgcctcccccgcgacgcccagtccag
tggcctcgcgtccgccattcagcggagacctgcggagaggcggcggccgcggcctccg
caagccgtctttctctagagttgtatatatagaacatcctggagtccaccatg

*Homo sapiens* 3'(2'), 5'-bisphosphate nucleotidase 1 (BPNT1):

(Seq ID No: 464)

catccttctcaaaagacttattgacagtgccaaagctcggtactggacacaac
gagggacctgggtctacgataacgcgcttttgctcctcctgaagtgtctttggtccaac
gttgttccagagtgtaccatg

*Homo sapiens* guanine nucleotide binding protein (G protein):

(Seq ID No: 465)

tttctctctctctctttcactgcaaggcggcggcaggagaggttgtggtgctag
tttctctaagccatccagtgccatcctcgtcgctgcagcgacacac
gctctcgccgccgccatg

*Homo sapiens* major histocompatibility complex, class II, DM alpha (HLA-DMA):

(Seq ID No: 466)

caccctctcggggagggagttggggaagctgggttggctgggtt
ggtagctcctacctactgtgtggcaagaaggtatg

*Homo sapiens* transmembrane protein 50B (TMEM50B):

(Seq ID No: 467)

tctccttcctgcgcgcgcgcctgaagtcggcgtgggcgtttgaggaagctgggatacag
catttaatgaaaaatttatgcttaagaagtaaaaatg

*Homo sapiens* lactoperoxidase (LPO):

(Seq ID No: 468)

cagtcttcctgctaa
gcctcagcgtctcctccaa
gccacatcaaaatcttttccttctgggccttttcccagaagtgaattcttgctg
gaaggtataaaagaccagctcctccaagcagagcaactccctggctgccgtgaaaaga
caaggcactgggcagtgatg

*Homo sapiens* NEL-like 2 (chicken) (NELL2):

(Seq ID No: 469)

ctgcctttacaaca
gagggagacgatggactgagctgatccgcaccatg

*Homo sapiens* nucleobindin 1 (NUCB1):

(Seq ID No: 470)

cgccctctgcggtgaaggaga
gaccacactgccatg

*Homo sapiens* paired box 9 (PAX9):

(Seq ID No: 471)

aagcctcttttcatcggggcacagacttccttttacttcttccttttgccctctcgcctcc
tcctcctgggaagaagcggaggcgccggcggtcggccgggatagcaacaggccgggccac
tgaggcggtgcggaaagtttctgtctgggagtgcggaactggggccgggttggtgtactg
ctcggagcaatg

*Homo sapiens* cyclin-dependent kinase 16 (CDK16):

(Seq ID No: 472)

cgcccttttattcttgctcggcctcgccacagagag
caaatcagattggctgggcgacaacctcaaagggcggggctgcacacgttcactacgg
gaatgaggtagcggtggaggggggcagttgggcggggataggccgtcctagctaaggtgg
taaaggccaataactcttcaggctgcctctcctcgaaaagtcatcttctcgcgaac
ctttaaaatgccttcctccccaagcacctcaaggggactagaactgagtgcttcattt
gtcttttttcctccttgcaaaagtcccgtttgccaccatggggatgtaccaagtgagac
cgagtagggggaacgagtggtgattgacgcgccaggttactggccactgctcac
ctaggcgctagcaaacttctgccaagatcggaactgagtactaaacagcctccacag
ttctccctggtgccgtctccggcttggcgccg
catcctcctctgggctcgcgatggccgcgtcccctcccgctgcggacgggtcctttgg
tacatg

*Homo sapiens* serpin peptidase inhibitor, clade E (nexin, plasminogen activator inhibitor type 1), member 2 (SERPINE2):

(Seq ID No: 473)

ctgcctctttccggctgtgaccctcctcgccgccgccgctt
ggctgcgtcctccgactccccgcgccgccgagaccaggctcccgctccggttgcggccg
caccgccctccgcggccgcccctggggatccagcgagcgcggtcgtccttggtg
gaaggaaccatg -continued

*Homo sapiens* pancreatic lipase-related protein 1 (PNLIPRP1):

(Seq ID No: 474)
aactcctttcccctgctgtgacgtacaggtgaggtaaacag
tactgaagtccagggcgtcggtgctcactgctctggcaatgcccggtga
gactgaattatgtttaaatttattgtagatg

*Homo sapiens* peripherin (PRPH):

(Seq ID No: 475)
ggctccttcccagccccggcctagctctgcgaacggtgactgcccatccttggccg
caatg

*Homo sapiens* RAD21 homolog (*S. pombe*) (RAD21):

(Seq ID No: 476)
gacccttttcccctccccgggccacccagcccgcccaactcccagcggagag
caaggttttcttctgttttcatagccagccagaacaatg

*Homo sapiens* signal sequence receptor, delta (SSR4):

(Seq ID No: 477)
ttttcttttcctctaggcagagaagaggcgatg

*Homo sapiens* tissue factor pathway inhibitor (lipoprotein-associated coagulation inhibitor) (TFPI):

(Seq ID No: 478)
ctccctcttt
gctctaacagacagcagcgactttaggctggataatagtcaaattcttac
ctcgctctttcactgctagtaagatcagattgcgtttctttcag
ttactcttcaatcgccagtttcttgatctgcttctaaaagaagaagtagagaaga
taaatcctgtcttcaatacctggaaggaaaaacaaaataacctcaactccgtttt
gaaaaaaacattccaagaactttcatcagagattttacttagatg

*Homo sapiens* ubiquinol-cytochrome c reductase binding protein (UQCRB):

(Seq ID No: 479)
gcttctctttctggtcaaaatg

*Homo sapiens* mitogen-activated protein kinase kinase kinase 12 (MAP3K12):

(Seq ID No: 480)
ccgccttttgtgctgcggccgcggagcccccgagggcccagtgttcac
catcataccaggggccagaggcgatg

*Homo sapiens* sushi-repeat containing protein, X-linked (SRPX):

(Seq ID No: 481)
tggtctcttcggtctcctgccgccccgggaa
gcgcgctgcgctgccgaggcgagctaagcgcccgctcgccatg

*Homo sapiens* aminopeptidase puromycin sensitive (NPEPPS):

(Seq ID No: 482)
cccctctccctccctcctt
gcgggccctcctcccttccctcccctccgccccttccccg
taggcagcccgcccgccagtccgcccgcac
cgcctccttcccagcccctagcgctccggctgggtctctcccccgccccccaggctcccc
cggtcgctctcctccggcggtcgcccgcgctcggtggatg

*Homo sapiens* fibulin 5 (FBLN5):

(Seq ID No: 483)
tcgccttctgcccgggcgctcg
cagccgagcgcggccggggaagggctctcctcccagcgccgagcactgggccctgg
cagacgccccaagattgttgtgaggagtctagccagttggtgagcgctgtaatctgaac
cagctgtgtccagactgaggccccatttgcattgtttaacatactta
gaaaatgaagtgttcattttaacattcctcctccaatt
ggtttaatgctgaattactgaagagggctaagcaaaaccaggtgctt
gcgctgagggctctgcagtggctgggaggaccccggcgctctccccgtgtcctctccac
gactcgctcggcccctctggaataaaacacccgcgagccccgagggcccagag
gaggccgacgtgcccgagctcctccggggtcccgcccgcgagctttcttctcgccttcg
catctcctcctcgcgcgtcttggacatg

*Homo sapiens* lysophospholipase I (LYPLA1):

(Seq ID No: 484)
cgctcttccttccgcttgcgctgtgagctgaggcggtgtatg

*Homo sapiens* high mobility group nucleosomal binding domain 4 (HMGN4):

(Seq ID No: 485)
tcgtcttctctgtcttagggctggtgctggccctgcccac
gcctagggctccggcgcgtcacgggcctcagctgggattccgcgccctcggac
ggccacgagactcggacatctttccaggaacagcgtgaggaggacagaa
gcacccaacaggactgctcaagccacctgcgaacactgctgctaccatg

*Homo sapiens* eukaryotic translation initiation factor 3, subunit M (EIF3M):

(Seq ID No: 486)

agttcccttttccggtcggcgtggtcttgcgagtggag
tgtccgctgtgcccgggcctgcaccatg

*Homo sapiens* Sec23 homolog A (*S. cerevisiae*) (SEC23A):

(Seq ID No: 487)

cctcctcttgacgtggcagaggcggcgccagccatg

*Homo sapiens* cartilage associated protein (CRTAP):

(Seq ID No: 488)

cgtcctctttcctttccttctccctccccttttcccttccttcgtcccttccttccttcc
tttcgccgggcgcgatg

*Homo sapiens* vesicle amine transport protein 1 homolog
(*T. californica*) (VAT1):

(Seq ID No: 489)

ccgcccctcccgctggatcccg
cagccgcggctcttcccgacgcgttccgccttccccagctgtgcac
tctccatccagctgtgcgctctcgtcgggagtcccagccatg

*Homo sapiens* importin 7 (IPO7):

(Seq ID No: 490)

gcttctctttcctttcgcgccggtt
gccgctgcggagcgcggcgggtccatgtgcgcagtgagtggcgctattcctggcccag
tagcacccgagcccgggtttgaccgagtccgcgctgcgatg

*Homo sapiens* ATG7 autophagy related 7 homolog
(*S. cerevisiae*) (ATG7):

(Seq ID No: 491)

gctcctttgcgcacgcgcgccgcttcccagtgg
caagcgcgggcaggaccgcgttgcgtcatcggggcgcgcgcctcagaga
gagctgtggttgccggaagttgagcggcggtaagtgagccgcggcgggcgagggtgtag
tggggtcttgctgggccggttttggaggcctggag
tcaaggggcgagctcgccaggagggcgagggtcacagcaagtctcag
gatcctcctctgccagtttctgggtggtccttcctcctccagggactcactgat
tccggctggcgcccttcgtctgtagccgcgtcccctcagactggttcag
tccggggtcttctgacttggaagctcgtgctgat
ttcctaagtcagcccctcctgtcctcttggtaggcagtgctcagaatcttcagtgtt
ggaacacgggagatgggacatttggattcccagcctggctgtgtctggattt
gctgtctctggcacgttccttcccatctaagctgcttttccatctgcaaaatgg
gaatgataatccgccatttgtttaagtgaggaggttaaataagtttactttctgagaaa
gaagattctcgattccttggttacagggttagaaactaatg

*Homo sapiens* dynactin 2 (p50) (DCTN2):

(Seq ID No: 492)

cgctcccttt
gccgccgccttagcccgggacccgaacccagcctctcccctacccgaacac
cggccccggctccaccgaggcccgggtccccagcccgtctcgccgccgccatg

*Homo sapiens* acidic (leucine-
rich) nuclear phosphoprotein 32 family, member B
(ANP32B):

(Seq ID No: 493)

agccccctttcccctccatggtttctctccgctcccgtgagtaactt
ggctccgggggctccgctcgcctgcccgcacgccgcccgccacccaggac
cgcgccgccggcctccgccgctagcaaaaccttccgacggccctcgctgcgcaagccgg
gacgcctctcccccctccgcccccgccgcggaaagttaagtttgaagaggggggaa
gaggggaacatg

*Homo sapiens* protein C receptor, endothelial (PROCR):

(Seq ID No: 494)

acttctcttttccctagactgcagccagcggagcccgcagccggcccgagccag
gaacccaggtccggagcctcaacttcaggatg

*Homo sapiens* actin related protein 2/3 complex, subunit 1A,
41 kDa (ARPC1A):

(Seq ID No: 495)

cgctccctctgggcttccgtcctccgcccgcgcccgacggagcctgttcgcgtcgactgc
ccagagtccgcgaatcctccgctccgagcccgtccggactcccccgatcccagctttctc
tccttttgaaaacactaagaataatg

*Homo sapiens* chaperonin containing TCP1, subunit 4 (delta)
(CCT4):

(Seq ID No: 496)

aggccccttctccgcctccgcctcctcccgacgccggcgccgctttctg
gaaggttcgtgaaggcagtgagggcttaccgttattacac
tgcggccggccagaatccgggtccatccgtccttcccgagccaacccagacacagcg
gagtttgccatg -continued

*Homo sapiens* Niemann-Pick disease, type C2 (NPC2):

(Seq ID No: 497)

gcttctttcccgagcttggaacttcgttatccgcgatg

*Homo sapiens* phosphoribosylaminoimidazole carboxylase, phosphoribosylaminoimida-
zole
succinocarboxamide synthetase (PAICS):

(Seq ID No: 498)

acccctcttttctagagttctgcctcgcttcccggcgcggtcgcagccctcagcccac
ttaggataatg

*Homo sapiens* ST6 (alpha-
N-acetyl-neuraminyl-2,3-beta-galactosyl-1,3)-N-acetylgalactosaminide
alpha-2,6-sialyltransferase 2 (ST6GALNAC2):

(Seq ID No: 499)

ctcccttctgcctgggacgtcagcggacggggcgctcgcgggccggggctgtatg

*Homo sapiens* polymerase (RNA) III
(DNA directed) polypeptide C (62 kD) (POLR3C):

(Seq ID No: 500)

aagccctttccgaggatggcaaaggatctgggaatgcttctccaaagatatgtggatgga
cgaaataggtctctggtgatactgaggcgggtggggacggggaggcaaagacttggctt
cttaggaattggaagaaataagtaaacaatgtttggtagcaatttgtaataaggaagtaa
tcataaaattaactacgtccgtttctgattgtgtcaactttgtcaaggagtagaagttta
agaattgaatactgtcctgcaaacaacgtaacctcatctcctgtttgacacaccctgttg
agaagcagtcctttacctcctaaattcttttttcgaaattatcatttcctttatggactg
agaataacactgcctgttcactcccaccgagctgtgaacagtgaccttaattcttccaag
cagggaagtgtagaaactaaggtctgtgacagaccgcaaaatcatctcccaatctttaag
gaaaatcagaatcacgcataatcccatagagataaatttgatgcatagtcttttcctatg
catacattttttccttttttttttacaataattgaattttttatattttttcagcttgcttct
gtcacttaatatattatgagtaattttttttggtttttttttgttttggagacagaatctc
gcactgtcgcccggttggagtgcagtggcgcgatctcggctcactgcaacctctgcctc
ccggcttcaagcgattctcctgtctcagcctcccagtagctgggattacaggcacccgc
caccacgcccagctaattttttttgtgtgttttagtagagaaggggtttcactatattgg
ccaggctggtctcaaactcctgacctcatgatacgcccacctcggtctcccaaagtgcta
ggattacaggcctgagccaccgcgccagcctattatgaataattttctacatgaatacgc
atcgtactaaataaactttaaatgttggtgtagtatgccattgtatgggtatggcatcatt
tattgttagacgttagattgtttccactaagtcggtattataaagagaactaatgacttc
attattattagcttttttctttctttggacacaatatccaaaaagaaattgttgtttcaaa
gatatgcaagatttttaaggcttttttgatatgtattgtcaaattgccctccagaaagaat
acatgaatttacactcagcagctctgcttccagcgtgaaagactttctattgtaccattt
tggtgttttttccctagctctcagactccccagtacaatg

*Homo sapiens* influenza virus NS1A binding protein
(IVNS1ABP):

(Seq ID No: 501)

gtgtctcccggtcgcgcgtg
gaggtcggtcgctcagagctgctgggcgcag
tttctccgcctgctgcttcggcgcggctgtatcggcgagcgagcgagttcccgcgag
ttctcggtggcgctccccttcctttcagtctccacggactggccctcgtccttc
tacttgaccgctcccgtcttccgccgccttctggcgctttccgttgggccgat
tcccgcccgcttcctcctgcttcccatcgaagctcta
gaaatgaatgtttccatctcttcagagatgaaccagat
tatgatgcatcattatcacagaagaaattcgtgtctatagcttttaaggacttgat
tacatcattttcaagcctgatagttttggaatcaccattagagcttaagacacac
ctgccttcatttcaaccacctgtcttcatacccctgacgaagtgcaccttttaacac
tcctttgtccttggattacttaagagttcccagaaatacatttgccaccaacagag
tagccaaatttataaggaaaaatg

*Homo sapiens* thioredoxin interacting protein (TXNIP):

(Seq ID No: 502)

acccctcttttctccaaaggagtgcttgtggagatcggatcttttctccagcaatt
ggggaaagaaggcttttctctgaattcgcttagtgtaaccagcggcg
tatatttttaggcgcctttttcgaaaacctagtagttaatattcattt
gtttaaatcttatttattttaagctcaaactgcttaagaatac
cttaattccttaaagtgaaataattttttgcaaaggggtttcctcgattt
ggagcttttttttcttccaccgtcatttctaactcttaaaaccaactcagttccat
catg

*Homo sapiens* ecotropic viral integration site 2B (EVI2B):

(Seq ID No: 503)

ttttcctttcttagccaaatcaccaaaatgtccagttagaacaagaatttagcattctg
caaaagaagttaacagctgagataacgaggaaatattctgaaatg

*Homo sapiens* guanine nucleotide binding protein
(G protein), alpha inhibiting activity polypeptide 3
(GNAI3):

(Seq ID No: 504)

ggttcttctgggcgctaagggagctgacggagagggccaccgcccagcaa
tagacggtgcctcagcctgccgagccgcagtttccgtggtgtgagtgag
tccgggcccgtgtccctctcccgccgccgccatg

*Homo sapiens* polymerase (DNA directed), eta (POLH):

(Seq ID No: 505)

cggcccttcgcagcgggcgcgctgtcagacctcagtctggcggctgcatt
gctgggcgccgctctcgtctgatccctgctggggacggttgcccgggcag
gatcctttacgatcccttctcggtttctccgtcgtcacagggaa
taaatctcgctcgaaactcactggaccgctcctagaaaggcgaaaagatattcag
gagcccttccattttccttccagtaggcaccgaacccagcattttcggcaac
cgctgctggcagttttgccaggtgtttgttaccttgaaaaatg

*Homo sapiens* solute carrier family 2 (facilitated glucose transporter), member 1 (SLC2A1):

(Seq ID No: 506)

cgctctctggcaagaggcaagaggtagcaacagcgagcgtgccggtcgctagtcgcgggt
ccccgagtgagcacgccagggagcaggagaccaaacgacgggggtcggagtcagagtcgc
agtgggagtccccggaccggagcacgagcctgagcgggagagcgccgctcgcacgcccgt
cgccacccgcgtacccggcgcagccagagccaccagcgcagcgctgccatg

*Homo sapiens* zinc finger protein 138 (ZNF138):

(Seq ID No: 507)

gggtctttgtctcgctgcagcgggtgctgcaggtctggccttcacttttctgcgtcctcttactccta
gaggcccagcctctgtggcgctgtgatctggttattgggagattcacagctaagac
gccaggatcccccggaagcctagaaatg

*Homo sapiens* ubiquitin specific peptidase 3 (USPS):

(Seq ID No: 508)

cttttctttgacgcaagggctcgagacgcagccgccgtcggccgagcgcccggctagaa
gcgacaccagacggagcctccggagttcctccgcccccacctcgccgggtcctg
gagccgcagtcctcccagctgccctcctcgtggccatg

*Homo sapiens* influenza virus NS1A binding protein (IVNS1ABP):

(Seq ID No: 509)

ctgtctttctccagtttgagcggggtgtcgggagcaggcgga
gagctttcctgcgaggctgtggaagcagtgaacactcttctcagcggctcgcctcccag
cagtgctattttttgccatccgccctcaccccagcacacgcgctcgcacacacac
gcacgcacgcacacacacacacacactcacacagagacctctctgggtttcttt
gccttgagtctcccggggctgtgagaagccaggcgcatctcaaaccgagctgg
cagctccaggctccggagccatgccctgcacggaccctcgtctttaccacgctcctgag
gaatgaaaggaacccagggacccctcagaaggcagcagtgatgcggaccaaccccccg
gagcctgcaccctccgagggccataggcgacccagggaactggaga
gagctccagaaaggaaatcccagctttcccaaagtccctgtggatgctgacaaaagga
gacctgaatttttggaagagcctgtactaggttaccggctgcagagtgat
tttccctccggcactgactctcccctccaaccccagccgtccagagtaccatgaa
gaattatg

*Homo sapiens* guanine nucleotide binding protein (G protein), beta 5 (GNB5):

(Seq ID No: 510)

ttccctctccgctgcgtccccgcgcgaagatg

*Homo sapiens* chaperonin containing TCP1, subunit 8 (theta) (CCT8):

(Seq ID No: 511)

cttcctccgcggtcttccgagcggtcgcgtgaactgcttcctgcaggctgg
ccatg

*Homo sapiens* prostaglandin E synthase 3 (cytosolic) (PTGES3):

(Seq ID No: 512)

cgctctttccgcgcggtg
cattctggggcccgaggtcgagcccgccgctgccgccgtcgcctgagggaagcgagaa
gaggccgcgaccggagagaaaagcggagtcgccaccggagagaagtcgactccctag
cagcagccgccgccagagaggcccgcccaccagttcgcccgtcccctgccccgttca
caatg

*Homo sapiens* zinc finger protein 266 (ZNF266):

(Seq ID No: 513)

ttttcttcctggtggcgtttgggcttaatacagctttggcgaggtcggatgacgggtggg
agccagcggtggaaggggtggcgaaagtaccggtttgccccaggccgccgaggggcctcc
ttagagagaccttgcctgctccgctcgctccgccggggccgcgggtcctcctggcgc
cgccaggttcaaaaagccactcgagttgtcactgcgacggcctgggccaggagccgttt
cgggatctgtcaaacaacgagttttcgtcgttcgaatcaggttgactggtccttcatccc
cccaatctcccgtacctggcgagtccagtcgtcgcggcaatgctaagaaaagagtgata
tgcaagctgagaccaaaaatatggtatgatttagccatactgaaggggaaggaaataaga
gctgggcaaagcattctgtgaattggctgactccacttctatggtgagagagaggagtgc
atcaaagattactcccagtagagatggtttcagcatgttggccagtctggtctcagactc
ctgacctcaagtgatccacccacctcggcctcccaaaatgctgggattacaggtataagc
cactgtgcctggccaaagataccgttaaccctggataaagagaatggaggttacctctgt
ccgtgtagattcctaagctgtcctggagtgatccttggagtaaaggaaaggtgctttgaa -continued gcacattcagccatcagccctgtgggatggcagccactgatttgtcctatggtctttaca
gggacccagtctgccttcaagaaaagacagaagtagaaagggtggtggctgactgtctga
caaattgttatcaggtatgcaggaagtatatccttctccaaaatatcatacttgcatcac
caggtagacacatttccttctacacagaattatcttcagagcttcttaaagcaaataaag
cctgcttcaaggactgagtccctagtcgaattcccggaaggagtggagcctgtcatattg
tgtttatctagcatctgctcaagagtgtgctgcagtggagggaaatcagatgacctccca
gtctggttgtgttacatacaatcatgtgtaagaagtgccattcaagccgtgtcactggag
gggactgacagtgagattcagtgacttttgatgatctggctgtggacttcaccccagaag
aatggactttactggacccaactcagagaaacctctacagagatgtgatg

*Homo sapiens* methylenetetrahydrofolate dehydrogenase
(NADP+ dependent) 2, methenyltetrahydrofolate cyclohydrolase
(MTHFD2):

(Seq ID No: 514)

gcttccctcccggcgcagtcaccggcgcggtctatg

*Homo sapiens* chemokine (C-C motif) receptor 9 (CCR9):

(Seq ID No: 515)

cttcctttctcgtgttgttatcgggtagctgcctgctcagaacccacaaa
gcctgcccctcatcccaggcagagagcaacccagctctttcccagacactga
gagctggtggtgcctgctgtcccagggagagttgcatcgccctccacagagcaggctt
gcatctgactgacccaccatg

*Homo sapiens* heat shock 105 kDa/110 kDa protein 1 (HSPH1):

(Seq ID No: 516)

cctccccttttgggtcggtagttcagcgccggcgccggtgtgcgagccgcggcagag
tgaggcaggcaaccccgaggtgcggagcgacctgcg
gaggctgagccccgctttctcccagggtttcttatcagccagccgccgctgtccccgggg
gagtaggaggctcctgacaggccgcggctgtctgtgtgtccttctgagtgtcagag
gaacggccagacccgcggccggagcagaacgcggccagggcagaaagcggcggcag
gagaagcaggcaggggccggaggacgcagaccgagacccgaggcggaggcggac
cgcgagccggccatg

*Homo sapiens* StAR-related lipid transfer
(START) domain containing 10 (STARD10):

(Seq ID No: 517)

tggtcctttcttttatgattcacaaggaatgaccctcttcatcgcctctcctaattcagt
cctcacaacagtccttttacaaatgggacaacaggttagaggaagtcaggcagatttcca
gcatcatagagagtaaaggaccagggaaggatcaggattcaaggactgcacccaggctct
gcttccagcttgctgtgtgactttgggtaattttgttcccttagggaactgagctttctc
atttgtaaatgcaaacaggctgttggggaggatcaaatgagatccaggggtgaaaacagct
tagtttactttcaggaatttacccacgcggtatataaaggcaaaatattattatagtcag
gtgattgtagattgaggaacccatttcctcattctgcaaattgcaaacctgagggcccaa
agagggacaggggcttgccccaggtctcagcaggctgtgagcaagagctaaagcctaatc
ctcctgcctttgggcctggagccctccttgtacccccaggggtcagtgtctttgttggat
acaggcttagattgactgactgtaccctgagaacctaggggagtccctgttcccaattct
tctcctacccccaccttggcctgatggaggaagaccctgctgtgttgagatgagcaccag
agccaagaagctgaggaggatctgagaattctggaggaagaggagagtgttgctggagc
tgtacagaccctgcttctcaggtcccaggaaggtggcgtcagcatctgcagccgcgtcga
cgttgtcggagcctccgcggaggacccaggagagccggactaggaccagggccctgggcc
tccccacactccccatg

*Homo sapiens* UTP14, U3 small nucleolar ribonucleoprotein, homolog
A (yeast) (UTP14A):

(Seq ID No: 518)

ctttccttcggcttccgttcttggtccatgtgaga
gaagctggctgctgaaatg

*Homo sapiens* SUB1 homolog (*S. cerevisiae*) (SUB1):

(Seq ID No: 519)

ggttctctgtcagtcgcgagcgaacgaccaagagggtgttcgactgcta
gagccgagcgaagcgatg

*Homo sapiens* minichromosome maintenance complex component 5
(MCM5):

(Seq ID No: 520)

ccgcctcttgttttttcccgcgaaactcggcggctgagcgtggaggttctt
gtctcccctggtttgtgaagtgcgaaaaccagaggcgcagtcatg

*Homo sapiens* RNA binding motif (RNP1, RRM) protein 3 (RBM3):

(Seq ID No: 521)

tactcttatcaatcgtcttccggcgcagccccgtccctgtttttt
gtgctcctccgagctcgctgttcgtccgggttttttacgttttaatttccaggactt
gaactgccatg

*Homo sapiens* KDEL
(Lys-Asp-Glu-Leu) endoplasmic reticulum protein retention receptor
1 (KDELR1):

(Seq ID No: 522)

ctccccctctcgctctcctccctcttcccggctccagctccgccgccagctccagcctt
gctcccctcccaaagtcccctccccggagcggagcgcac

```
ctagggtccctcttccgtcccccagcccagctaccgttcagaccagcagcctcggggg
gcaccccccgccagcctgcctccctcccgctcagccctgccagggttccccagccatg
```

*Homo sapiens* StAR-related lipid transfer
(START) domain containing 3 (STARD3):

(Seq ID No: 523)
```
agatcttcttccgctctgaggcgctactgaggccgcggagccggactgcggtt
ggggcgggaagagccggggccgtggctgacatggag
cagccctgctgctgaggccgcgccctccccgccctgaggtgggggcccaccaggatg
```

*Homo sapiens* heterogeneous nuclear ribonucleoprotein A0
(HNRNPA0):

(Seq ID No: 524)
```
cggcctctttgtgtggtgcccagatagggagcggaggtggcggcggcggcggtagcggt
ggccttggttgtcttccagtctcctcggctcgcccttagccggcaccgctccccttccc
tcccccttcctctcttccttccttccctccccttcccttttttccttccccgtcggtgag
cggcgggggtggctccagcaacggctgggcccaagctgtgtagaggccttaaccaacgat
aacggcggcgacggcgaaacctcggagctcgcagggcgggggcaaggcccgggccttgga
gatg
```

*Homo sapiens* chromobox homolog 1 (CBX1):

(Seq ID No: 525)
```
ggctcttt
gttcggctgaggggagggccgttggccggggcctgcggtacgccgcttcagtgagggac
gccactgcggccacccggcttgctgccttcctgggcgccactccccccaggcgacccgac
gcgacgcgccagcagcgcagcaccgattcctctcgggctctt
gggcgctgctctgaggtgaggagcccgctggaggcgggagagctgggg
gagggggcgcggcggcggcggcggcgggagccctgcgtgagggaac
gcgctttcgaggcggaggttaggagcggg
gagcgcgcccgggtccagcgtcctgcttctccgcttcccgcgctgagctcttcgcctgtc
gctgaggcgtcggtgccagctgcgtgaaggatgga
gagggcggggcgcgaatcctgagccagagactgagtgcttgggggtgggccgagcactt
gggggccgctcttcggggcccgggtggtctggaacaatgttgctt
ggctgggcggctgcgggatagggcggaaggggacaggcttgaggcttgga
taggcgtgaggaggcgcatacgaccgcacaacccgaggtttgtaactgtattcggaa
gacgccgggtccggctgggactgccagaggaacctggctttgcaggactacggaggag
taacgtcgagtgaattggaagagggcccagggccgcacaagcagcgtcacccctttacac
cagaaagctggcgggcactatg
```

*Homo sapiens* myeloid/lymphoid or mixed-lineage leukemia
(trithorax homolog, Drosophila); translocated to, 11
(MLLT11):

(Seq ID No: 526)
```
cgcccttcttaggagggggctgcattgcaggggagag
tgaactgacagactcagtcactgaagagggaaaaggagtgagaagacaaagccgtcaaa
gccccaacagctttgtatttctccagcccggcgcagaccccggagctcccgaggcac
tccctccatctttggaacacgccagtaattgattgataacaggaagctatg
```

*Homo sapiens* interferon-induced protein 44-like (IFI44L):

(Seq ID No: 527)
```
ttttctttctttcctagagtctctgaagccacagatctcttaa
gaactttctgtctccaaaccgtggctgctcgataaatcagacagaacag
ttaatcctcaatttaagcctgatctaaccctagaaacagatatagaacaatg
```

*Homo sapiens* cyclin I (CCNI):

(Seq ID No: 528)
```
acttcttcctccctcccctctcttccctccctccccagccttccccgcgagcggacgc
ggcagcgcctctgtctcgcttttttcttattttccccccttcccctttcttttttttt
tttcttttcttttctccctccccccctttcaccatttccctcggaggcgctttccccg
ggcaggggcagagccggtctcacccccgcctctccccggccccgccgccctatggcga
gagggagccccctcccaacccgggctcgagcggcggcggcctcaggccgggggtcatcat
ggaactaattcgctgaccgacccagcggccgcagccgtgcgtcccgctcgagcgccagcg
cccgcgccgcgcccccgatccgcttccccttctccctcctcagttggccgagtcgtc
ccgcgcgcaccgctccgcgcgcctatgagaatgaggtggtaacgggcccccggatgacc
ccgcgtcaccactgtgaggcctacagctctgccggggaggaggaggaggaggaagaggag
gagaaggtagctacagcaagctgggtagcaggcagatccaaaggatatcatg
```

*Homo sapiens* methionyl aminopeptidase 2 (METAP2):

(Seq ID No: 529)
```
cattccctcgcgctctctcgggcaacatg
```

*Homo sapiens* leukocyte immunoglobulin-like receptor, subfamily
B (with TM and ITIM domains), member 4 (LILRB4):

(Seq ID No: 530)
```
gtctcttt
gtcctgccggcactgaggactcatccatctgcacagctgggccctgggaggagacgc
catg
```

-continued

*Homo sapiens* destrin (actin depolymerizing factor) (DSTN):

(Seq ID No: 531)

gggtctctcggtcccgcagccgtgaggaggacggtctgcat
actcgctgcccgccggctccctcccccgcgtccctgcgaccgccgcggcgaagatg

*Homo sapiens* eukaryotic translation initiation factor 2D
(EIF2D):

(Seq ID No: 532)

gggccttttcgcggccgggccccagcatggctgccccac
ggctgagggcctggcagctgctgcgccctcgctttctt
gacattccctggcttctgtgctctcttccccaggccaccccagcagacatg

*Homo sapiens* histamine N-methyltransferase (HNMT):

(Seq ID No: 533)

ctgtctttctcagaaaaccaaatatg

*Homo sapiens* ras-related C3 botulinum toxin substrate 1
(rho family, small GTP binding protein Rac1) (RAC1):

(Seq ID No: 534)

gtttctctgcagttttcctcagctttgggtggtggccgctgccgggcatcggcttccag
tccgcggagggcgaggcggcgtggacagcggccccggcacccagcgccccgccgcccg
caagccgcgcgcccgtccgccgcgccccgagcccgccgcttcc
tatctcagcgccctgccgccgccgcgcccagcgagcggccctgatgcaggccatca
agtgtgtggtggtgggagacgaaacaagaatctcagtgtaacccgag
caaaatcgcgcgtctcagccgttgcttgtatagagctgtaggtaaaacttgcc
tactgatcagttacacaaccaatgcatttcctggagaatatatccctactgtcttt
gacaattattctgccaatgttatg

*Homo sapiens* signal recognition particle 72 kDa (SRP72):

(Seq ID No: 535)

tcgtctcctccaagatg

*Homo sapiens* zinc finger protein 33B (ZNF33B):

(Seq ID No: 536)

ccgcctttcctttgtttgtctcacgttttgcgtgggaggcggtcccgggat
ttcagggtctaccggctctcttatggcgaatgcaacccgaagagagagtgagctg
tatcttcagagttgtctccgtcttccaagaacagaacaaaatg

*Homo sapiens* zinc finger protein 16 (ZNF16):

(Seq ID No: 537)

gcctccttccaa
gcgcgacccgttgaggtccttgtcatg

*Homo sapiens* zinc finger protein 33A (ZNF33A):

(Seq ID No: 538)

ccgcctttcctttgttttctcaggttttgcgtgggaggcggtcccgggatttcaaggg
tctacgcgcttttctatggcgaatgcaacccgacgagggagtgggctgtatcttcagagt
tgtctccgtcttccaagaacagaacaaaatg

*Homo sapiens* butyrophilin, subfamily 3, member A3 (BTN3A3):

(Seq ID No: 539)

ctttcttttccttcttcggaatgagagactcaaccataatagaaagaatggagaac
tattaaccaccattcttcagtgggctgtgattttcagaggggaatactaa
gaaatggttttccatactggaacccaaaggtaaagacactcaaggacagacattttgg
cagagctgctcactccttgctcagctcagttttctgtgctt
ggaccctctgggcccatcctggccatg

*Homo sapiens* butyrophilin, subfamily 2, member A2 (BTN2A2):

(Seq ID No: 540)

ctctttgggatgctttgttgtctggtggtgactgtgcccatgggtgagttgtatcg
gaaaatcgtcatgtgaggatcagaggggaaaa
gaaaacagaggcctctggtctctgcctgccctgggtgctcatg

*Homo sapiens* nudix (nucleoside
diphosphate linked moiety X)-type motif 21 (NUDT21):

(Seq ID No: 541)

acgcctcctcttgcgctgtcctgttaatggcgggcagtagccgctgaggggattgcaga
taaccgcttcccgcacggggaaagtctaccctgcctgccac
tttctgctcgccgtcagcgccggagctcgccagcatg

*Homo sapiens* stathmin-like 2 (STMN2):

(Seq ID No: 542)

tgctctttctctagcac
ggtcccactctgcagactcagtgccttattcag
tcttctctctcgctctctccgctgctgtagccggaccctttgccttcgccac
tgctcagcgtctgcacatccctacaatg

*Homo sapiens* katanin p60 (ATPase containing) subunit A 1 (KATNA1):

(Seq ID No: 543)

caccctcttccgccgctcccgcccagcgacctcgctcccggggcgac
gccccgcgtgcgccagagtcgccgaggtcgtccccggcaccg
gaagtgaccctggcggggtttgtcttcaaattctcggcgagcaggagccgcgccgg
caggtggtgttgacgattgaactgggcagtactggggccgtgagcggagag
caaagtgggctggactgggtcaggccctccttcctcgctgccgggatctccac
tccgccaatcccctgtgcctggcgttgggcggtttcccgaggagcttgggccgccg
cagcttacagttgaacatg

*Homo sapiens* butyrophilin, subfamily 3, member A2 (BTN3A2):

(Seq ID No: 544)

cttttctcttttttcctttcttccggatgagaggctaagccataatagaaagaatgga
gaattattgattgaccgtctttattctgtgggctctgattctccaatgggaatac
caagggatggttttccatactggaacccaaaggtaaagacactcaaggacaga
cattttttggcagagcatagatg

*Homo sapiens* CLK4-associating serine/arginine rich protein (CLASRP):

(Seq ID No: 545)

cggccttttcatttccgcttccggtgcgggccgcgcgcgagcg
cagcggtgggaggcggcgaccagccggttgaggcccaggcttggcctcaccacaatg

*Homo sapiens* clathrin, light chain A (CLTA):

(Seq ID No: 546)

ctccctcctggcgcttgtcctcctctcccagtcggcaccacagcggtggctgccgggcgt
ggtgtcggtgggtcggttggttttttgtctcaccgttggtgtccgtgccgttcagttgccc
gccatg

*Homo sapiens* NADH dehydrogenase (ubiquinone) flavoprotein 1, 51 kDa (NDUFV1):

(Seq ID No: 547)

gcgtctctatcgcgccag
ttcctcagcctcagtgctatgaaggtgacagcgtgaggtgacccatctggcccgccg
cgatg

*Homo sapiens* signal sequence receptor, gamma (translocon-associated protein gamma) (SSR3):

(Seq ID No: 548)

gggcctttgcccgcctt
ggcggccggtctacgttccctgttctcgcctgcagctccgccatg

*Homo sapiens* valosin containing protein (VCP):

(Seq ID No: 549)

gcttcccttccgatgattcggctcttctcggctcagtctcagcgaagcgtctgcgac
cgtcgtttgagtcgtcgctgccgctgccgctgccactgccactgccacctcgcg
gatcaggagccagcgttgttcgcccgacgcctcgctgccggtgggaggaagcga
gagggaagccgcttgcgggtttgtcgccgctgctcgcccaccgcctggaa
gagccgagccccggcccagtcggtcgcttgccaccgctcg
tagccgttacccgcgggccgccacagccgccggccgggagaggcgcgcgccatg

*Homo sapiens* zinc finger protein 195 (ZNF195):

(Seq ID No: 550)

gggcctttt
gtcccgacagagctccacttcctgtccccgcggctctgtgtccctgctagccg
taggtcgtgtgacccgcaggcaccgggagatccagaagtgaaacgccaggctctctg
gaggccaggagatg

*Homo sapiens* testis-specific kinase 2 (TESK2):

(Seq ID No: 551)

cag
tctttcgcggcccgggagctcagcagagctaccagctgccctgttggcttcgctggtcg
gatcgtcctcctggccccgccaaacaggcgggg
gagcggccccgactgtggggccatggcagtag
tctcctcgttcgccgccgccgctagcctagctgag
tcgccggcttctgcgctaggggctcccaccgcctccgcaggctaaggagccgctgccac
caacgagctgtgagggttactatgctccctctttgccgccgtctcctcctctt
gcccgcgcaggcaccctctggctgctcagtcctgcctcagtgtcaaaccagaaga
gaagtaaaattcaacaaaaatttatgtgtggagttccttcttaaaagaa
gaaaaagtgattatttagactatg

*Homo sapiens* family with sequence similarity 107, member A (FAM107A):

(Seq ID No: 552)

agccctccttgctagtctgggacttcccggtggagtgaggaacccag
caacacgctcctgacttcccttcccaaggactcgacctgagaaggacacagcag
tctctgaatttcatgctctcctctttgatgtgaagaaaatgaaaagctgaacagttgtg
gaactgtggatagagttagacaataaggccgccatg -continued

*Homo sapiens* serine/threonine kinase receptor associated protein (STRAP):

(Seq ID No: 553)
```
ccctccctccctttccctcctcgtcgactgttgcttgctggtcgcagactccctgaccc
ctccctcaccctccctaacctcggtgccaccggattgcccttcttttcctgttgcccag
cccagcccagtgtcagggcggggcctggagcagcccgaggcactgcagcagaagagag
aaaagacaacgacgaccctcagctcgccagtccggtcgctggcttcgccgccgccatg
```

*Homo sapiens* mitochondrial ribosomal protein L3 (MRPL3):

(Seq ID No: 554)
```
cttttctttccgtcgcagagagcatcggccggcgaccgttccggcggccatt
gcgaaaacttccccacggctactgcgtccacgtggcggtggcgtggggactccctgaaa
gcagagcggcagggcgcccggaagtcgtgagtcgagtcttcccgggctaatccatg
```

*Homo sapiens* zinc fingers and homeoboxes 1 (ZHX1):

(Seq ID No: 555)
```
ctcccttcccctccgcccccggacggccgctggggcgcgcgcctctcctcg
caccccaccctgagtccccacactccgcggggccaccgagctgctgaggcccttt
gcgggcccgccgagcggttccgggtttagggttcacaggtcagagtt
gactccctgaaaagtgcagccggtttgaaatgcaagatggcggcggcgtggcgctga
gaggcgcggcggcccctgcaggagaagacagactgctgctttggacctgttgg
taatgatggcctgagctaaacatctaactagaagggataccccttccatttcaaa
gaacagaatgctaaggaagctgtggcaagtgattggagtt
gtgcttcaaaaatttcagaaattcagcagtattttatctgccaacaataa
gctcttacttgattgcaccatgagaaagctgctaatgagacttgttgag
cacaaaaatggacttgaagaaccaaaagccattgttttcaaatgaagaacactgaacag
ttttaagcctcgatgcttttaatcaccactgagcttttcctcataacatcagaatg
```

*Homo sapiens* calcium binding protein P22 (CHP):

(Seq ID No: 556)
```
ccttccttccctccctccttccctcctgtcgccgtctcttctggcgccgctgctcccg
gaggagctcccggcacggcgatg
```

*Homo sapiens* ecdysoneless homolog (Drosophila) (ECD):

(Seq ID No: 557)
```
cttttctctcaggatttccgctggcttcaggttccggtcaggcgtcgg
gacagagcctgatccaggcttcggcggccggtggcagctctcgatcagctctcgcag
tcggagaggcggctaaggaaaggtgccacagcagagacgcgaaggagaggccctagaac
cttttcaaagaagaatg
```

*Homo sapiens* V-set and immunoglobulin domain containing 4 (VSIG4):

(Seq ID No: 558)
```
gagcctctttggtagcaggaggctggaagaaaggacagaagtagctctgg
ctgtgatg
```

*Homo sapiens* prohibitin 2 (PHB2):

(Seq ID No: 559)
```
tgcccttctttcgccagccttac
gggcccgaaccctcgtgtgaagggtgcagtacctaagccggagcgggg
tagaggcgggccggcaccccttctgacctccagtgccgccggcctcaagatcagacatg
```

*Homo sapiens* signal transducer and activator of transcription 1, 91 kDa (STAT1):

(Seq ID No: 560)
```
ctgccttttctcctgccgggtagtttcgctttcctgcgcagagtctgcggaggggctcgg
ctgcaccggggggatcgcgcctggcagacccagaccgagcagaggcgacccagcgcgct
cgggagaggctgcaccgccgcgcccccgcctagcccttccggatcctgcgcgcagaaaag
tttcatttgctgtatgccatcctcgagagctgtctaggttaacgttcgcactctgtgtat
ataacctcgacagtcttggcacctaacgtgctgtgcgtagctgctcctttggttgaatcc
ccaggcccttgttggggcacaaggtggcaggatg
```

*Homo sapiens* heat shock protein 90 kDa alpha (cytosolic), class B member 1 (HSP90AB1):

(Seq ID No: 561)
```
agctctctcgagtcac
tccggcgcagtgttgggactgtctgggtatcggaaagcaagcctacgttgctcac
tattacgtataatccttttcttttcaagatg
```

*Homo sapiens* cancer susceptibility candidate 3 (CASC3):

(Seq ID No: 562)
```
cgttctccgtaagatg
```

*Homo sapiens* nuclear cap binding protein subunit 2, 20 kDa (NCBP2):

(Seq ID No: 563)
```
gcttctctgcactatg
```

-continued

*Homo sapiens* non-POU domain containing, octamer-binding (NONO):

(Seq ID No: 564)

cgctcttttctcgggacgggagaggccgtgtagcgtcgccgttactccgagga
gataccagtcggtagaggagaagtcgaggttagagggaactgggaggcacttt
gctgtctgcaatcgaagttgagggtgcaaaaatg

*Homo sapiens* lectin, galactoside-binding, soluble, 9 (LGALS9):

(Seq ID No: 565)

atttctttgttaagtcgttccctctacaaaggacttcctag
tgggtgtgaaaggcagcggtggccacagaggcggcggagagatg

*Homo sapiens* chaperonin containing TCP1, subunit 5 (epsilon) (CCT5):

(Seq ID No: 566)

cggtctccgccggttgggggaagtaattccggttgttgcaccatg

*Homo sapiens* haloacid dehalogenase-like hydrolase domain containing 1 (HDHD1):

(Seq ID No: 567)

cttcctcctcgcccccacccagacccagaaggcgccaccatg

*Homo sapiens* glutamate dehydrogenase 2 (GLUD2):

(Seq ID No: 568)

cttccttcctagtcgcggggagtctgagaaagcgcacctgttccgcgaccgtcac
gcaccCctcctccgcctgccgcgatg

*Homo sapiens* general transcription factor IIIC, polypeptide 3, 102 kDa (GTF3C3):

(Seq ID No: 569)

ggttctctgtcccggttcctggggttgcacagacagaccct
gtaaacatg

*Homo sapiens* general transcription factor IIIC, polypeptide 5, 63 kDa (GTF3C5):

(Seq ID No: 570)

gggtccctcgctggctagtaggagagactggtgcttgccccgcccggtggactaactcgc
ttaattttaaataaaaagtcgaggacacggcggtcgttttcccgaagacatgggccctcc
catgggccatttgctccctggaggccctcgcgtcttgctgagcccggggagttaggatga
cgcgagcggtgagggagcccggaacgattccttcgcggaacaattgaggcgaggcctttg
ggagtactttgtgggacggaccctggcgggccctgccagacgcacagggatg

*Homo sapiens* ancient ubiquitous protein 1 (AUP1):

(Seq ID No: 571)

ccgccttcccaagagccctgcggccgggcgcgaaaatggcggcggcggcgac
ggccgggcgctcctgaagcagcagttatg

*Homo sapiens* coatomer protein complex, subunit gamma 2 (COPG2):

(Seq ID No: 572)

cggccttcctgcagcctcttccgctcgccggctgcggcgcctgggac
ggttgcggtgggtctgggcgctgggaagtcgtccaagatg

*Homo sapiens* apoptosis antagonizing transcription factor (AATF):

(Seq ID No: 573)

cggtctctggcggagtcggggaatcggatcaaggcgagaggatccgg
cagggaaggagcttcggggccgggggttgggccgcacatttacgtgcgcgaagcggag
tggaccgggagctggtgacgatg

*Homo sapiens* integrator complex subunit 6 (INTS6):

(Seq ID No: 574)

tctcctctttctccaccacctcgggccccggtgtccccggccagcactatg

*Homo sapiens* F-box and leucine-rich repeat protein 4 (FBXL4):

(Seq ID No: 575)

tcttccttccgggtcgcgctaggccgggcttgcggcggttgtgccg
catctagagagtcggggagccgcccccg
cacccaggccttctcgcgctgcctggtcgctggtgaa
gcccgcggcgcgcgcctctcccggaccctgcagggtaaaagaatgtcacatgtcag
catttgtacctgaagtcagcatgcaaagttcagggtacctggatgaatgccaacttt
gcatttcccatgtgtatcctgtgaccattctatctgggaacatccttcaaagag
ttcatgcatcttactgaggacacctgaccttttgaagcttcataattcacatctagatg

*Homo sapiens* guanine nucleotide binding protein
(G protein), gamma 3 (GNG3):

(Seq ID No: 576)

gctccttctag
catccttcatccttcaggtaccagccatccagacagtgcttgagctgcagaaactga
gaccagacctctggcctggccctcccaggggcctcctttcgtatagtcactgcttctg
catcagatactttcagctgcaactccctactgggtgggg
cacccatttcaggcagaaggttttggtaccctccactgaccctacacccagggctgc
tactgccgcttgtggcttcaggatg

*Homo sapiens* histidyl-tRNA synthetase 2, mitochondrial (putative)
(HARS2):

(Seq ID No: 577)

aggccttttgttcctgtcccggaaagccggcgtcctgccgcg
cgatg

*Homo sapiens* interleukin enhancer binding factor 3, 90 kDa
(ILF3):

(Seq ID No: 578)

cctcctcctcctcttctcgccattgcagttggacccagcagcccggcgcg
caccgcgtggcttttgggggcagaccccggcgggctgtggcag
gagggcggcggcggcggctgcggtcgaagaagggacgccgacaagagtt
gaagtattgataacaccaaggaactctatcacaatttgaaaagataagcaaaagttt
gatttccagacactacagaagaagtaaaaatg

*Homo sapiens* polymerase I and transcript release factor
(PTRF):

(Seq ID No: 579)

gtttcctctgctctccgctctcgcccgctagctctcctcccttccgctcctgcttctctc
cgggtctcccgctccagctccagccccaccggccggtcccgcacggctccgggtagc
catg

*Homo sapiens* 5'-3' exoribonuclease 2 (XRN2):

(Seq ID No: 580)

tgccctctgccgctgctcccgtctctttggttac
gctcgtcagccggtcggccgccgcctccagccgtgtgccgctatg

*Homo sapiens* 2-hydroxyacyl-CoA lyase 1 (HACL1):

(Seq ID No: 581)

ccgcctcttccttcccgttgtttaaggcagttggttgccctcctgtccgtcagaggtg
cagtaccagaggtggcgtgctgccgatttcgcgtttgccttgctggatgattccgctt
gtttgccggctgcgtgagtgcttagagcttttcggtggaagatg

*Homo sapiens* zinc finger protein 346 (ZNF346):

(Seq ID No: 582)

ggctctctac
cggtgagggtttgcggggaagatg

*Homo sapiens* microtubule-associated protein, RP/EB family, member
3 (MAPRE3):

(Seq ID No: 583)

cagtctctgtgcgttgaagccggagac
cgcggcggcctcagcgaggaccctccgccccggagccgccggccggagccg
cagcctctgccgcagcgcccccgccacctgtcccctcccctccgcctccgccg
gagccgcctcgtgcactctgggtatg

*Homo sapiens* splicing factor 3b, subunit 3, 130 kDa (SF3B3):

(Seq ID No: 584)

gtgccttttccgccgcgcgccaccagaatgtccctgtcttgaggtctaatggcggac
gccagtatgttggagttggtggtggcttaagttttgaagggaggtagcatccgttgga
tatccacaccatccttctcgctgcaggctttcttggactccgtactgttggtgtaac
caaggcctggaggtctgggtggctcaggtttcctgcagccatg

*Homo sapiens* spondin 2, extracellular matrix protein
(SPON2):

(Seq ID No: 585)

ctgcctctcgctggaggccaggccgtgcagcatcgaagacaggag
gaactggagcctcattggccggcccggggcgccggcctcgggcttaaa
taggagctccgggctctggctgggacccgac
cgctgccggccgcgctcccgctgctcctgccgggtgatg

*Homo sapiens* solute carrier family 13 (sodium/
sulfate symporters), member 4 (SLC13A4):

(Seq ID No: 586)

ttttcttttctgctttgcaggcccaggctcaaggcaaattataagtagggaaccaatttg
agggaaagacatgtgaacagagttaaggtaccacgtcctgggagcgaccagcagccccac
ctgaagtccgcatgcaactctgacaagctcaggtgcttgttttaaggaaggggctacta
gagtcttaccaacagcgagcccaggtgggagatgaaacaggtactccccaaaataggtca
tccgagggaggaaaactgatgagagcacaatgtgctctgagcgttttaatgttttaa
gcttttaaatgatttcttcaaggccgagcagcagcagcaaaggtgtggcttaaaggatta -continued aggggggtttctgctgacacctagaatgaagttactctattactaatcaagccgagaggag
gcccactatgccccgtttatcatcctttcccagttccttttttgctggtcacaaaacgat
gctcatcaatcccacctaaagcaggaggcaggagcccagcctcttgtagaaacagcgag
ggtataactgccctcccgttctgcccccaagacgaaggaggactctcggaagccaagaaa
ggtttaagaagtctttctggatagagagcagtgcccaggcaggaagcctttcgccggcag
agcggggtccaaggacgagctggagaggacagaggcgcgatg

*Homo sapiens* PRP6 pre-mRNA processing factor 6 homolog
(*S. cerevisiae*) (PRPF6):

(Seq ID No: 587)

attcctttccttcctagccttggtcgtcgccgc
caccatg

*Homo sapiens* eukaryotic translation initiation factor 3, subunit
K (EIF3K):

(Seq ID No: 588)

ccacctcttcctgttcccgtccttgaggacgccgtgccgggtcag
tgttagcctccagccctggttgtggaaggcgacagaagtcatg

*Homo sapiens* ataxin 10 (ATXN10):

(Seq ID No: 589)

cccctccccgcggcgccgtctcctcctcccgcctgaggcgagtctgggctcagccta
gagctctccggcggcggcgcagcttcagggcagcgcgggctg
cagcggcggcggcggttagggctgtgtagggcgaggcctcccccttcctcctcgccatcc
tactcctccctcctcgtcatcctccccctttcgtcctcctcgccttcctcctcctcgtcag
gctcgacccagctgtgagcggcaagatg

*Homo sapiens* secretogranin III (SCG3):

(Seq ID No: 590)

cttccttcctcac
ttcctctgcaggagggagcgagagtaaagctacgccctggcgcgcag
tctccgcgtcacaggaacttcagcacccacagggcggacagcgctcccctctacctgga
gacttgactcccgcgcgccccaaccctgcttatcccttgaccgtcgagtgtcaga
gatcctgcagccgcccag
tcccggcccctctcccgccccacacccaccctcctggctcttcctgttttttactcctcct
tttcattcataacaaaagctacagctccaggagcccagcgccgggctgtgacccaa
gccgagcgtggaagaatg

*Homo sapiens* polymerase (DNA directed), mu (POLM):

(Seq ID No: 591)

cttccttccgtctcgctcggagtttccctctgcgttcgctccgcgctgctg
gaggctgtcgtcccaatg

*Homo sapiens* epsin 1 (EPN1):

(Seq ID No: 592)

cctccttctgtt
gcttcccgtctcctcggcggctcccctccccccgccggctctccgcgcccccttctgggcg
gcggggcggcggagccgtcggcgtgcggccctcctt
gcgttcgtgcgtgcgcccgtggcccggcgcacgtcccgcgacaccgaggccgagcgggg
caggggggctgaccgccatgaccccccagagcccggcgtgaggggggccga
gatgcggtgacctgccagcacctgccgcagccttcgtccgggag
tcgccccatctctccacgcatcggggccctgtgccccttgctgctgcagccgggcac
catg

*Homo sapiens* Sec61 alpha 1 subunit (*S. cerevisiae*)
(SEC61A1):

(Seq ID No: 593)

gtgtctctcggcggagctgctgtgcagtggaacgcgctgggccgcggg
cagcgtcgcctcacgcggagcagagctgagctgaagcgggacccggagcccgag
cagccgccgccatg

*Homo sapiens* Obg-like ATPase 1 (OLA1):

(Seq ID No: 594)

cgttctctcctccttcctcccccgcctccagctgccggcaggaccttctctcgctgccgc
tgggaccccgtgtcatcgcccaggccgagcacgatg

*Homo sapiens* sorting nexin 12 (SNX12):

(Seq ID No: 595)

ag
gcctctgtcccccacccccttccccggtcccaggctctccttcggaaagatg

*Homo sapiens* LAG1 longevity assurance homolog 2
(*S. cerevisiae*) (LASS2):

(Seq ID No: 596)

cggccttttttcccggctgggctcgggctcagctcgactgggctcggcgggcggcggcg
gcggcgccggcggctggcggag
gagggagggcgagggcgagggcgcgggccggcgggcgggcggaagagggagga
gaggcgcggggagccaggcctcggggcctcggagcaaccacccgagcagacggag
tacacggagcagcggccccggccccgccaacgctgccgccggctactccctctt
gatgccctcccctttgcccctcactcaggatg -continued

*Homo sapiens* cytohesin 4 (CYTH4):

(Seq ID No: 597)

tcatcttttcccca
gaggcgtcggaatg

*Homo sapiens* transportin 2 (TNPO2):

(Seq ID No: 598)

aattctctctcttt
ggctccctccttccgcgcgagtctctggagaagccgcagcgcgagtt
gccgccgctgctgcccggggccgggtaagtgggcctcactcagagcccgaccctctt
ggccccggcttgcgtcgaccccgccgggcac
cgagcctgcgccgcgcgcgccgggcgtcggggccgcgcccgaccgggaaggccgg
gaagccggttgggcccgatcctcctggcagctagaacgggccgggcggggaggggg
gaaccgagcagagcttaggggtggggcctcggagccaggccatgtcggggctcctcaa
gaagagggccagtgggactgctggggtcgggctggaggggatctgattgggggaa
gcgtctggggactgcttggggcctgattgggggacgtcgcgaggatcggcttgcctt
gcgccatg

*Homo sapiens* makorin ring finger protein 1 (MKRN1):

(Seq ID No: 599)

gggcctttgctgtgtgggataaacagtaatg

*Homo sapiens* vinculin (VCL):

(Seq ID No: 600)

ctgtctcttcgccggttcccggccccgtg
gatcctacttctctgtcgcccgcggttcgccgccccgctcgccgccgcgatg

*Homo sapiens* DEAH (Asp-Glu-Ala-His) box polypeptide 38 (DHX38):

(Seq ID No: 601)

cctccttttcctgcccccagactagaggcgggatgtag
tctcttaggctaagagtgattggtcacaaggagactcg
gaagtgtctgatcagagccccagaggaggccttgagagcctgttggcgtac
cgttccacacttggatccaggaatcgggcgtgttccaggctgctctctatggtagcttt
gggcggatagagggggcgcgcaaagtattaagggacaa
taatggccgcttttcaaggtgtggattttggctccttgagcctgtctgagcgaggggtgg
cagcgccggcgcccagaatccgggacagaagggtcccaagagtcgcgcttggtgaga
gaaatcccagatcctgtgatg

*Homo sapiens* osteoglycin (OGN):

(Seq ID No: 602)

catcctctaagcttttaaatattgcttcgatggtctgaattttatttccagggaaaaag
agagttttgtcccacagtcagcaggccactagtttattaacttccagtcaccttgatttt
tgctaaaatg

*Homo sapiens* NIN1/RPN12 binding protein 1 homolog (*S. cerevisiae*) (NOB1):

(Seq ID No: 603)

gctcccctctcacgcagccaacatg

*Homo sapiens* nudix (nucleoside diphosphate linked moiety X)-type motif 5 (NUDT5):

(Seq ID No: 604)

catcctttagcaccgcgagaggcgccggtgtttcgagccgtggcaccgg
catcggctgacactgctgcctccagctag
ttatttcgtcctcttccgttcttcaccccctacaccttggaggtgaacttctcac
ctgagggctgtaaagactcgtttgaaaatg

*Homo sapiens* WD repeat domain 91 (WDR91):

(Seq ID No: 605)

cgtccctcaccgcac
caccctaaagacgctagcgctgcgatg

*Homo sapiens* nuclear transcription factor Y, gamma (NFYC):

(Seq ID No: 606)

gggcctctgcattgcccgactccgtaggagcgcggggcggctcctgctcttcctg
gactcctgagcagagttgtcgagatg

*Homo sapiens* protein phosphatase 2, regulatory subunit A, alpha (PPP2R1A):

(Seq ID No: 607)

ccgcccttccttcttctcccagcattgccccccccacgtttcag
cacagcgctggccgcagtctgacaggaaagggacggagccaagatg

*Homo sapiens* vesicle-associated membrane protein 2 (synaptobrevin 2) (VAMP2):

(Seq ID No: 608)

ccatctttccgtcccgggcagccagcgccagtcg
gagccagcgcgagccgccgccgccatcac
tgccgctgccaagtcctccacccgctgcccccgccatg -continued

*Homo sapiens* transmembrane protein 5 (TMEM5):

(Seq ID No: 609)

gat
tctctttccgcccgctccatggcggtggatgcctgactggaagcccgagtgggatg

*Homo sapiens* UDP-GlcNAc:betaGal beta-1,3-N-acetylglucosaminyltransferase 3 (B3GNT3):

(Seq ID No: 610)

aactctttcttcggctcgcgagctgagaggag
caggtagaggggcagaggcgggactgtcgtctgggggagccgcccag
gaggctcctcaggccgaccccagaccctggctggccaggatg

*Homo sapiens* SEC11 homolog A (*S. cerevisiae*) (SEC11A):

(Seq ID No: 611)

gcgccctttcccctgccggtgtcctgctcgccgtccccgccatg

*Homo sapiens* RUN and SH3 domain containing 1 (RUSC1):

(Seq ID No: 612)

ctccctccccgcgcccgtcctctcccgccctacaggccctagcagggcaggcgggaggt
gagcgcggccatcccgctcccggagttccgggatcctggagtccgtagttcgtggtcctt
cgccggtgtccccggagcccagcggctgtggatg

*Homo sapiens* aryl hydrocarbon receptor interacting protein-like 1 (AIPL1):

(Seq ID No: 613)

cctccctttctcctgcagccatg

*Homo sapiens* tumor necrosis factor, alpha-induced protein 8 (TNFAIP8):

(Seq ID No: 614)

cctccttttctcccgccggctctaacccgcgctt
ggctaaggtccgcgggaacccgtgagccaccgagagagcaga
gaactcggcgccgccaaacagcccagctcgcgcttcagcgtcccggcgccgtcgcgccac
tcctccgatg

*Homo sapiens* staphylococcal nuclease and tudor domain containing 1 (SND1):

(Seq ID No: 615)

gcgtctctttcgctccgtgtcccgctgctgctcctgtgagcgcccggcgag
tccgtcccgtccaccgtccgcagctgg
tagccagcctgcccctcgcctcgactccctttcaccaacaccgacacccacattgacac
ctccagtccggccagccgctccactcgttgcctttgcatctccacacatg

*Homo sapiens* DNA segment on chromosome 4 (unique) 234 expressed sequence (D4S234E):

(Seq ID No: 616)

cgccctctttt
ggtcgcccctccccaacccagcactaaggagcaccctgctctggtctccgccac
cacccagcgcctcctggacccatccccccaaacccttgaacgtcctcag
gaccccaggtgagcgcggcgcgctgcgggcggggaccctctctgcacctccccg
cacccctgggggtcgctctgtccctacggtccccgcctccccttctcctttctaa
gcgcctcgcgcccaggccgccgcccggggtggcgcagcccg
cagccctcccgctccgggcgccctccgccgctccga
gaccccctgggggcgcgtcctctcccgctcccctgttccctcccccggctcagggcgggc
gcgtggtcccaggggaggctcccgcccagccccgcactccttt
gtgcggccgggcgggcgctgcgtcaaggtggaggcgcggccacacgcgcg
cacccacccgcgcgcacccagcccccgggagaggcaggaagggaggcggcggcgcgag
gaggagggagcggccgtg
gagcccaatcgttcgctccccttcccgggtccgcgcgcggcgccgcctccgccatt
gctgcgagcaggagcaggagacgcggagctcggagcgctcagctgacctgccg
gagccgggcgtgggctgcagcctcggagctcccggaacgatg

*Homo sapiens* growth hormone inducible transmembrane protein (GHITM):

(Seq ID No: 617)

acgtcctttcgatgttgcgtcatgcagtgcgccggag
gaactgtgctctttgaggccgacgctaggggcccg
gaagggaaactgcgaggcgaaggtgaccggggaccgagcatttcagatctgctcgg
tagacctggtgcaccaccaccatg

*Homo sapiens* stress-associated endoplasmic reticulum protein 1 (SERP1):

(Seq ID No: 618)

tttccttcctctttcactccgcgctcacggcggcggccaaagcggcggcgacggcggcgc
gagaacgacccggcggccagttctcttcctcctgcgcacctgccccgctcggtcagtcag
tcggcggccggcgcccggcttgtgctcagacctcgcgcttgcggcgcccaggcccagcgg
ccgtagctagcgtctggcctgagaacctcggcgctccggcggcgcgggcaccacgagccg
agcctcgcagcggctccagaggaggcaggcgagtgagcgagtccgaggggtggccggggc
aggtggtggcgccgcgaagatg -continued

*Homo sapiens* ADP-ribosylation factor interacting protein 1 (ARFIP1):

(Seq ID No: 619)

cggtctcctcacttccggcttcgctgctcttggttctggttctg
gaggctgggttgagaggtcgccggtccgactgtcctcggcggttggtcagtgtgaattt
gtgacagctgcagttgctccccgccccgagcagccgaggagtctaccatg

*Homo sapiens* tumor necrosis factor receptor superfamily, member 21 (TNFRSF21):

(Seq ID No: 620)

ccgccccttcggcgccaccac
gtgtgtccctgcgcccggtggccaccgactcagtccctcgccgaccagtctgggcagcg
gaggagggtggttggcagtggctggaagcttcgctatgggaagttgttcctt
gctctctcgcgcccagtcctcctccctggttctcctcagccgctgtcggaggagag
cacccggagacgcgggctgcag
tcgcggcggcttctccccgcctgggcggccgcgccgctggg
caggtgctgagcgcccctagagcctcccttgccgcctccctcctctgcccggccgcag
cagtgcacatggggtgttggaggtagatgggctcccggcccgggaggcggcggtg
gatgcggcgctgggcagaagcagccgccgat
tccagctgccccgcgcccccgggcgcccctgcgagtccccggttcagccatg

*Homo sapiens* sushi-repeat containing protein, X-linked 2 (SRPX2):

(Seq ID No: 621)

cccctcttctgcagcagacggactgag
ttcctctaatccctgtgttccttctcccccatctttctaaaaccttctctgagagag
gaataactatagcttcagggataatatagctttaaggaaacttttggcagatgtggac
gtcgtaacatctgggcagtgttaacagaatcccggaggccgggacagaccaggagccac
tcgttctaggaatgttaaagtagaaggttttttccaattgatgagaggagcagagag
gaaggagaaagaggaggagagagaaaaagggcacaaaatacca
taaaacagatcccatatttctgcttccctcactttttagaagttaatt
gatggctgacttctgaaagtcactttcctttgccctgg
tacttcaggccatatacatcttttcttgtctccataatcctcccttcaaggatg

*Homo sapiens* HIV-1 Tat specific factor 1 (HTATSF1):

(Seq ID No: 622)

ac
ctccctttctctgctcagctccagcgtcatttcggcctcttag
ttcttctgaaccctgctcctgagctaggtaggaaacatg

*Homo sapiens* trafficking protein particle complex 2 (TRAPPC2):

(Seq ID No: 623)

gggtctcttccgcggaaactgacattgcgtttccgttgtcggcctcccactgcaggagcc
atatattgaagaccatg

*Homo sapiens* UDP-N-acetyl-alpha-D-galactosamine:polypeptide N-acetylgalactosaminyltransferase 5 (GalNAc-T5) (GALNT5):

(Seq ID No: 624)

ccaccttttcttgggcttgtaggaaggtggacatgggctcccggagacaagacaagtga
tatgttgaactgttcggtggctggaatcaactgctcctggagtgacctaaggccag
tgtttatcagaacttagccaggggccagccaagcaggcacagatgctctgc
tatgaaatgccacgcaggcagagactgacaagcggtaggaactgagctttcccctt
ggactgctgcttcctgctgtgttcaggggagggggtcactttctgg
caactctgctgctgctgctgctgctgctacttcagcttcctctccactcaaggtaa
gcaggctaagggagggcaggctgctagggaaagctttgtaccatg

*Homo sapiens* transmembrane protein 97 (TMEM97):

(Seq ID No: 625)

tggcccctcttctcacatcagcgggtccaggcccaaccgacagactatg

*Homo sapiens* EH-domain containing 2 (EHD2):

(Seq ID No: 626)

cgtcctccccgctccgggcccacccggctcagacggctccggacgggaccgcgag
cacaggccgctccgcgggcgcttcggatcctcgcgg
gaccccaccctctcccagcctgcccagcccgctgcagccgccagcgcgcccgtcgg
cagctctccatctgcacgtctctccgtgaaccccgtgagcggtgtgcagccaccatg

*Homo sapiens* tubulin tyrosine ligase-like family, member 4 (TTLL4):

(Seq ID No: 627)

cgccctcttcttccagactctcggtctgtccgctgggggcgcgcgcggtgtgtgg
caggcggcagcggcgctggcggccgagtcgcgcttgtcacgcgtggcggtgcgtggtt
gctaggggcgcctgaggctgccgggtagcccagcaggccgagggaggaagtagcgtg
gagccggtgccgagccggggcgaagctggatcccctagatagactgtcttcaagctcac
tgatattttcctctgcttgatccattgtgctgttgagagcctctag
taaattttttcagactgacagacttcaaggatgcagctgctactaccggaggtgtgtgg
caccttacctcagcaaggccatgagaccgtgtggccatgatgtgggcccctcatg -continued

*Homo sapiens* basic leucine zipper and W2 domains 1 (BZW1):

(Seq ID No: 628)

acctctccctcctcctggcgttagttccggtcgcagaggagacaccgccgcagtt
gccggtacatcggggatttctggctctttcctcttcgccttaaattcgggtgtcttt
tatg

*Homo sapiens* centrosomal protein 57 kDa (CEP57):

(Seq ID No: 629)

ttgcccttctgtgtaagctgtgagcgtaggcggccctgaggggtgtgtt
gcaggggtttccaagcccagcaccagcaccctt
gcccttttccatcaggggttcagcctaggtccccgctggtgggcggctcccgagtctt
ggagaagagcacgagaacctagaccgcccccgaagtgcggagacccctggg
caggctgaaagatg

*Homo sapiens* family with sequence similarity 115, member A
(FAM115A):

(Seq ID No: 630)

ctgcccttgcctcctgggcggagaagctgcttcctcctgggaacaaccgcctcccgctc
ctagcaggttgctactgccccgaacccgcgctgcagggaacagcggggcaaacagtgagt
gggttcagcgtagactctggaccaggagaggcccgcggtgaccgaggcctgggccccgg
aaaccaatagagccatg

*Homo sapiens* ATG13 autophagy related 13 homolog
(*S. cerevisiae*) (ATG13):

(Seq ID No: 631)

agccctctttcaccccccccccggccattac
cgaagcggatgaaaacaaacactaacgatggcggcgccgggaagcgac
cggctgctgggcttaaggcgggagtgaccgcttaaccagtgagggaagcactgaa
gagcgccagtcgacgtgggtgcgacaactcgcggagtcttaggagcaaaac
gtctggggcctgcgagccaggaccccttctgaagccttaggtgtcatcggcgacgtg
tacggtcactgcagctccggagcgcggaaccctcagccag
gaggcgcggctggtcggtcccaggtcccgcctccgtaatgagagcccggaaccac
tctttgtgccgcagcttcgcagcatcttggactcaagtgat
tctcctgcctcagcctcctgagtagctgggactacagattcctataggcaatg

*Homo sapiens* sorting nexin 17 (SNX17):

(Seq ID No: 632)

ccgccttcccacatcg
gatcgcagggctcccaaaatggcgagtgaggctgcggggactcgctgagcagcg
gaggggagcgtgcagagccgctgcggcccctcacagtccg
gagcccggccgtgccgtgccgtagggaacatg

*Homo sapiens* phytanoyl-CoA 2-hydroxylase interacting protein
(PHYHIP):

(Seq ID No: 633)

cgttctttctcccttctctgcctctctctcctccacgctgctttgat
ttcgctcttgcctctcttcttgcgctgctcagctgggaacatcgtctctcaccaggggcag
cagcgacgcgctgcacagccagacaggagctggctgcggggcatggaagcagcctcctt
ggcagccgggagaggagcaagcgcacgccac
tgcccgtgacccaggcgtccggctgctgtcccctgccggggagctcatccac
gcagaggtctctccctgtcctccctgcgagcttttcctctgcagagcccagtg
gagccagtccccacaggagacaaccctgacgggagcatg

*Homo sapiens* translocase of outer mitochondrial membrane 20 homolog
(yeast) (TOMM20):

(Seq ID No: 634)

cggcctttctgtgttcctggcccgcgccgtcgggtgtgagctgcgccgac
cgctctgagggttcgtggcccaccgctccttcgcggtccctgccgccaccgtccac
gctcagcgttgtagagaagatg

*Homo sapiens* KIAA0141 (KIAA0141):

(Seq ID No: 635)

cggcctttctagccgctgtcccaagggtt
ggtctcgcgcttcggctgcgagctctctgtggtgctggcagcgacatg

*Homo sapiens* janus kinase and microtubule interacting protein
2 (JAKMIP2):

(Seq ID No: 636)

ctccctccttttaaacagcttctccgggtctcagcatgggcttccagggcagcgattgagg
agacccttaccaaggagcaccacacagtagatgctgagacatcgtactccaggataagaaa
cagtaacatggcagcacctgcttgaaagaaattaaaaaccaacagactccatttagaaag
gaacaatg

*Homo sapiens* EPM2A (laforin) interacting protein 1
(EPM2AIP1):

(Seq ID No: 637)

cctcctctcccttgcggcctttctaacgttggccctgctcttgtgg
cctcccgcagaatg

*Homo sapiens* centrosomal protein 170 kDa (CEP170):

(Seq ID No: 638)

cggtctttt
gccgttaccgctatgtgtgggcgtgtgtggaataacgttattgcccagcg
gagctgagggccccggagctcgaccgcagcggcagcgacgacaacagcggcgacgac
gacgacgacgaggtgggggaggacggcgtgcgagagactcacgggacgcgac
gcgccccgcctcccccgtccggtccctctctccacggtaaggggatgacgtagctttt
gccaaagacttagaagctaagcagaaaatg

*Homo sapiens* suppressor of Ty 7 (*S. cerevisiae*)-like (SUPT7L):

(Seq ID No: 639)

aggcctctcgaggtccagacagccgcccagcccgctctgcgacgcag
cagtgaatagtgtggtacctccttgtctcggttcaggtccagac
ctccccgtcttccggctgccctgaacgtcaggcgacctcag
gaccctgtgattggcgcctgcgccggcggaccgtgaccgaggaaacccctg
gagggacttgggcattccttgggctccgtgcctgttcttcgtgctccttcggg
caaggatctcacattatcagtctttgaccgacacagaatgcctggcatttga
taaatgtttgttgaacttgaagagacatatggacaatg

*Homo sapiens* non-SMC condensin I complex, subunit D2 (NCAPD2):

(Seq ID No: 640)

ttttccttttcatttcagcctgactgccggaatcagagccgcgggtga
gatccccagccctgtgagcctgtaggagtagaatg

*Homo sapiens* ring finger protein 10 (RNF10):

(Seq ID No: 641)

ggttctttga
gatgctgtttggcgactcgtcgccattcccggag
caggtcggcctcggcccaggggcgagtatccgttgctgtgtcggagacactag
tccccgacaccgagacagccagccctctcccctgcctcgcggcggga
gagcgtgtccgccggccggccggcggggctcgcgcaac
ctccctcgcctcccccttcccccgcagcctccgccccgccaggcccggcccg
gactcccgagccccggcctcctcgtcctcggtcgccgctgccgccgggcttaacagcccc
gtccgccgcttctcttcctagtttgagaa
gccaaggaaggaaacagggaaaaatgtcgccatgaaggccgagaac
cgctgccgccgccgacccccgccggccctgaac
gccatgagcctgggtccccgccgcgcccgctccgctccgactgccgtcgccgccgaggcc
cccgttgatg

*Homo sapiens* PAN2 poly(A) specific ribonuclease subunit homolog (*S. cerevisiae*) (PAN2):

(Seq ID No: 642)

agcccttcttgattggaagaagcgcctcg
gaccccggtccttggcgccgtagtggttaggttgagccctaggcgtgggga
gaactggggaaactggaatttcccgcggagctgacagcgctt
gcgctcccctactcgttctaattccacgcgctccaaaatatccgccatgga
gaaatcttggccaggatgtccattctaggccatcggtgctgtcttgctgaaggtt
gggtcaggcatctaaagggactgtggtaagggagggtgtgacacaggtgtaa
gctgccatcgtcatcatg

*Homo sapiens* CD302 molecule (CD302):

(Seq ID No: 643)

gctcctctccggccgcg
cagccgctgccgcccacccgcacccgccgtcatg

*Homo sapiens* NSA2 ribosome biogenesis homolog (*S. cerevisiae*) (NSA2):

(Seq ID No: 644)

gactcttttcctgtcccggcctgcgtggtgtgggcttgtgggtctttga
gacccgaaaattgagagcgttttcgcac
tccagcggctgctcctggcggctctgcggccgtcaccatg

*Homo sapiens* DIS3 mitotic control homolog (*S. cerevisiae*) (DIS3):

(Seq ID No: 645)

acgccttttgctggaagagcgctgctggggttaggattctgcgcggcgagg
caagatg

*Homo sapiens* caspase recruitment domain family, member 8 (CARD8):

(Seq ID No: 646)

cctcctctgcgagcgttatttcaaaagaagttgagaaccagagaaac
cgacctaagggattctcccatttggcccgtcctaccctaaagtcaccac
ctgctgcttttctggagcgcttaccagtgaccaagaggaacagaacacagag
cagcctggcagtgtccaagcaacaagcctccgctcctccttcctg
caccctggggctcctgaaactcacatgggtaaaaaagatacagtaaagacataaatac
cacatttgacaaatg -continued Homo sapiens epsin 2 (EPN2):

(Seq ID No: 647)

ccgcctctcgagcgctgccggtggccg
cagcggcgcacccacgccggcccggaggagcagagtgttcatttctgtgtcgggcacag
tgctaagtgctgggtgctcactggtgatgaggcagatgaaggttaccaaacttgtg
gacaggagcctcatatcagagacgtggacctcactg
tagcctggtcatggcttccagcttttcgaatctgaggctccaaaggaggaaatgac
cattcagggatcttactccagcttgattacggagactgaaccttcatagggtgcgcac
ttaccaaggacaggaaggtttctctgtttgaagggctttaaacttataacaaagaaaa
taaaaatg Homo sapiens pyridoxal-dependent decarboxylase domain containing 1 (PDXDC1):

(Seq ID No: 648)

ccgcctctcaaccatcaggttcggcagccgcggcgccgcctgg
cagctcctcctcttctccgccccgccggccgcgggcgcggggac
gtcagcgctgccagcgtggaaggagctgcggggcgcgggaggaggaagtagagcccgg
gaccgccaggccaccaccggccgcctcagccatg Homo sapiens nicotinamide nucleotide adenylyltransferase 2 (NMNAT2):

(Seq ID No: 649)

ccttcctttctccctctgcagacacaacgagacacaaaaaga
gaggcaaccctagaccaccgcgaaggacccatctgcaccatg Homo sapiens mitochondrial ribosomal protein S27 (MRPS27):

(Seq ID No: 650)

tgttccttttggtacgctccaagatg

Homo sapiens leucine-rich repeats and calponin homology (CH) domain containing 1 (LRCH1):

(Seq ID No: 651)

tcccctccttccagcgcctttcggtggagcactgcggcac
tcagcccgagctgccgttttcccctcgcggggaacgctgtgaccccccgcag
gagcggcggggcgggtgggggggcccgggagaagatg Homo sapiens PAS domain containing serine/threonine kinase (PASK):

(Seq ID No: 652)

gctcctttccgtggtgtgtagccggcttggcgtgaccctcgcctgatccagttgttagag
ttggaagcttggcagttggcctcccttcttcccatg Homo sapiens megalencephalic leukoencephalopathy with subcortical cysts 1 (MLC1):

(Seq ID No: 653)

cttcctttcctagttgggttctgacagctccgaggcag
tggtttacacaaccaacacgaaacatttctacgatccacccgattcctcccctcattga
tattcaggaagcagctctccttcccctgccttcagctcaagtttgctgagcttt
gtttcatttgtgaatacttcttgctggaagtccctcacccagagaccagtgctcccaac
ggcagagcagcgggggagataaagaactggtgacacgtggctgtacattcag
cacagctgtggtgtccccaagtgccatg Homo sapiens RRS1 ribosome biogenesis regulator homolog (S. cerevisiae) (RRS1):

(Seq ID No: 654)

ctttcttttccggattgggcatcccggcatctg
cacgtggttatgctgccggagtttgggccgccactgtaggaaaagtaacttcagctg
cagccccaaagcgagtgagccgagccggagccatg Homo sapiens formin binding protein 4 (FNBP4):

(Seq ID No: 655)

cgctctctgctcgcgcttgggctcgcgatg

Homo sapiens peptidylprolyl isomerase domain and WD repeat containing 1 (PPWD1):

(Seq ID No: 656)

gcgccttttctgacgatgcgaacaacatg

Homo sapiens sorting and assembly machinery component 50 homolog (S. cerevisiae) (SAMM50):

(Seq ID No: 657)

ccgccttctgccctcagcagcagac
gctctgtcccgcccgggcagctctgcgaggcagcggctggagagggaaccatg

Homo sapiens Yip1 domain family, member 3 (YIPF3):

(Seq ID No: 658)

gcttctcctttttgtgttccggccgatcccacctctcctcgaccctggacgtctac
cttccggaggcccacatcttgcccactccgcgcgcggggctagcgcgggtttcagcgac
gggagccctcaagggacatg

*Homo sapiens* tectonin beta-propeller repeat containing 1 (TECPR1):

(Seq ID No: 659)

caccctcttgcccggtccccgggagggccggtccgctcctcccggac
gccgaggacctaccaccgcgacttcgccccgcccggcgcgggcccag
gaccctgatgtcgcttttgaacagcccctgcacctggcagccagcgagctactgtag
taggcattgccgactgtttgcataccggatgggagtgacagtgtaatagaaaaacaa
gcaagaaacctttaggtaggactcctaaggctcagaggaagttacctccagccgctgc
catg

*Homo sapiens* DDB1 and CUL4 associated factor 12 (DCAF12):

(Seq ID No: 660)

ccttcccttcccggctcaagtccttcctctctcttcctttcttccgcctatctttt
tctgctgccgctccgggtccgggccattttccgggccgggcgcactaaggtgcgcggccc
cggggcccagtatatgacccgccgtcctgctatccttcgcttcccccgcccatgtggct
gcggggccgcggcggcgctgcccactatg

*Homo sapiens* chromosome 3 open reading frame 17 (C3orf17):

(Seq ID No: 661)

ccgcctttcgtaagtcccccccgcctcgcatg

*Homo sapiens* LETM1 domain containing 1 (LETMD1):

(Seq ID No: 662)

caac
ctcttctctcccgcttctctcgctgtgaagatg

*Homo sapiens* chordin-like 2 (CHRDL2):

(Seq ID No: 663)

ctcccttctgctggac
cttcctcgtctctccatctctccctcctttcccgcgttctctttccac
cttttctcttcttcccaccttagacctcccttcctgccctcctttcctgcccac
cgctgcttcctggcccttctccgaccccgctctagcagcagac
ctcctggggtctgtgggtt
gatctgtggcccctgtgcctccgtgtccttttcgtctcccttcctcccgactccgctccc
ggaccagcggcctgaccctggggaaaggatg

*Homo sapiens* CCR4-NOT transcription complex, subunit 10 (CNOT10):

(Seq ID No: 664)

actcctctagccggaacctgggggcccggagccggggtaggcacagag
ttgtcctcggaggtccaggacagcggccagcccggcggcgggagtcagggccacgccac
ctgcagggaagaacccgagtcgaagcgggaagatg

*Homo sapiens* THUMP domain containing 3 (THUMPD3):

(Seq ID No: 665)

cttcctctt
gcagttgaggccggcgccgagccggacttcaggcggatctcgtggcggagcccatctt
gctccctctcccaggcctttacccgctccctaggattcccggggccctgtaggtgggag
ttgggagacgacagtactgcttttaaagagacagtgttagggatcttggaa
gcacagccaacatg

*Homo sapiens* nipsnap homolog 3A (*C. elegans*) (NIPSNAP3A):

(Seq ID No: 666)

gctcctttccactcgggaaaccttcagaggagtctcagaaaggacac
ggctggctgcttttctcagcgccgaagccgcgccatg

*Homo sapiens* CAP-GLY domain containing linker protein 3 (CLIP3):

(Seq ID No: 667)

gcccctccctctccgcccccacccctgtcggcgtctgggcctcgtcccttctctctgt
ctcccttgcctcccccatcacgtccctgacaccgacaccccattgctcccacag
tctccccagtctccactttggtccccagcgctgtctgcccgaggattt
gcctgaaggctgcccccaactctgcacccgcccccgagggccaccgaggaccatg

*Homo sapiens* ring finger protein 167 (RNF167):

(Seq ID No: 668)

cacccttcccgaagttttctgtcac
ctgtgttaggctccgtcccctttccgcgttttatccccgtaccagaaaaggata
catttagtgcctcccacccagctccactaaacgggttggatatctcattctttgagtt
ggtgttccttccccggcgcccccatgtagctgggaagtgggacctgggggtggtt
ggaccctgggatcctaaaggaggggcagggagggcgcagaactccgcttctgctcctt
gctaccaggacgcgcggcctcctcagcctcttcctcccgctgccatg

*Homo sapiens* polymerase (RNA) II (DNA directed) polypeptide M (POLR2M):

(Seq ID No: 669)

cgttcttccgggaaaatggcgactcccgctcgtgcccggagtcaccgccgtccgcggat
ccggcgctag
tagcggggcctgccgaggaagccgagtgcccgccgccgcgccagcctcagcccgcgca
gaatg

*Homo sapiens* dihydroxyacetone kinase 2 homolog
(*S. cerevisiae*) (DAK):

(Seq ID No: 670)

tcgcctctttccgccagcgcccgcaggacccg
gatgagagcgcacgcttcggggtctccgggaagtcgcggcgccttcggatgtggcg
gatgcggccgtgagccggcggggaggtgctgctgctgcctccactg
tactcagacccaggtagcacaggattgtccatcctccagcagctcagtgcaac
ggtgtgaactcagcctgtttcagagcctccacaccatg

*Homo sapiens* RNA polymerase II associated protein 1 (RPAP1):

(Seq ID No: 671)

cgatctctgcggggcaagatggcggcgcccagacaggcctggagcacggatgaataa
gagggaaccccccacacggagacactgctgagagagtcgtactggggaggcagctggag
cagcaagatg

*Homo sapiens* torsin A interacting protein 1 (TOR1AIP1):

(Seq ID No: 672)

cctcctctttggtgcctccagccaggaggcgggagcgatccacag
cagctgacccagctcaggcactgcctctctcacagccctcaagacacac
catgggcccagaggcaggtttgctacacagcagcgacgac
gcaggcggcggccccagcgactcgcaactgcctccctgaccacagcggccac
cgcccaacaccccgagaagccatcgccaccaccggcaggagaacctagggtccataaa
gccatcttcgcgatcgactaaagctacgtcaacaactatg

*Homo sapiens* SERPINE1 mRNA binding protein 1 (SERBP1):

(Seq ID No: 673)

cccccctctctcggcccggccatcttgtgggaagagctgaagcaggcgctctt
ggctcggcgcggcccgctgcaatccgtggaggaacgcgccgccgagccaccatcatg

*Homo sapiens* N-acetyltransferase 9 (GCN5-related, putative)
(NAT9):

(Seq ID No: 674)

cacccctttctgcgggggacgatttcgtcggtggtaggctgctaccatg

*Homo sapiens* ribosomal L1 domain containing 1 (RSL1D1):

(Seq ID No: 675)

gcgcctcttcacgaggtggaaacaagatg

*Homo sapiens* SH3 domain containing, Ysc84-like 1
(*S. cerevisiae*) (SH3YL1):

(Seq ID No: 676)

cttcctcttcctgggcagcctcgggacggggcg
ccgcggccgggcgggcagcatg

*Homo sapiens* methylmalonic aciduria (cobalamin
deficiency) cblD type, with homocystinuria (MMADHC):

(Seq ID No: 677)

acttcctttgcctgctcaccgccagcgtaggtgctaccac
cgctgccgtcgccgccgccattttgatggcaggaagagtccggttctgggacagctg
gagacagtggtggtgactgaaataactttaccaaaggaaagctattttgcgaac
tatcttctccagcggagatg

*Homo sapiens* glioma tumor suppressor candidate region gene 2
(GLTSCR2):

(Seq ID No: 678)

agttcttcctttgacaagatg

*Homo sapiens* DDB1 and CUL4 associated factor 8 (DCAF8):

(Seq ID No: 679)

cagtcttctcgagcacatcgtcgcaaacggggccggaaagcgtggcag
cgcaggcgcaagcgcagagagcggaggcggtggtggtggcggccgctggccagttcctt
cagtgaatctacagacctatttctcaggagctcagcctggccttacttcagtga
taaaaggaggaaaggctggctacagcaaacatcattcaagatg

*Homo sapiens* UBX domain protein 1 (UBXN1):

(Seq ID No: 680)

ctttcttctcgtcggtgttcccggctgctatagagccgggtgagagagcgag
cgcccgtcggcgggtgtcgagggcgggttgcctcgcgct
gacccttcccgccctccttctcgtcacacaccaggtccccgcggaag
ccgcggtgtcggcgccatg

*Homo sapiens* antizyme inhibitor 1 (AZIN1):

(Seq ID No: 681)

ccgccttctcacac
tttcaggctct
gatcgcggccgcagttttcctttttcttctgccgtcgccttctctgcctcttct
catcctttctcgctctgctgctctgcagtgtgacgagtccgaatcctcttcccacccag
cccgcgcctttcttcttttgcctgcgctgttctatttctccttcggccgccgccgccac
tgctgcacacagctggtgtcggtgccgcgcttttaccccaagtcgttcccgcagcc
tatgggcccaggccgccttgggtatttctgctcaaggtaaccacatccctctt -continued

```
taaaaattccgccgaaaaagagaagacgctttacccgactctttgggccgttatct
cacgcgaactttctgaccaagtatacaactacccagagggcctaggagaagtgctgta
tagagagcagttcgacttcaacgctgagccaccttgggaacctagctgatgatag
gggggttccatctcccaacttgtccatggaggtcttcacttcagaaatccaagactca
tattcatccagcttggtgtcaagtgggctgttgctgccagaattatcttgtgattattt
gagagatgtatcagtttcttctgaagtacaatcaactgtagaagcctttgtag
cagtttgttgcatattctaaggacccagacatag
gcttggtggccgtctcttgtctttcctggtttatgactttcggctttgtg
gaatacggctgagatg
```

Homo sapiens cell division cycle 40 homolog (S. cerevisiae) (CDC40):

(Seq ID No: 682)
```
gcctcttcttcttccgccctggcagggtctccgca
gaagatttgttgccgtcatg
```

Homo sapiens stathmin-like 3 (STMN3):

(Seq ID No: 683)
```
gcgcctctccag
cctccgcaggcccaaccgccgccagcaccatg
```

Homo sapiens nudix (nucleoside diphosphate linked moiety X)-type motif 13 (NUDT13):

(Seq ID No: 684)
```
tttcctcttttgtgctgattcctgaggactaggaaggtgccccgaaaagaattcagaga
cctgacaatg
```

Homo sapiens calcium homeostasis modulator 2 (CALHM2):

(Seq ID No: 685)
```
ctctcttttctggagttagattagtctgaagccgccaccagccccaggcccccgtgcaga
agaaaagcgggagggaacggcggaggccgccgctgccctgcaccgccctcctggaggcca
cttgagagtccggccccgaggaggccatggccacaagtgcccacagctggccccaggtt
gccagcgtcgctacagcccagaccaaggcagaataatctccggatgagctggtggcaccg
ctgagcctttggtctcaccagggcttcctgttgctggcaggcggggtggagcggagctgc
tgggaggctgctggataggagagggtcacggctgcggaagggaggttcttcgggacac
ccgtggatggacacggcaaggaaacaccaggccaaccacagctgggataaaatagcaca
accacaccctgccgtccagcgcctcccagcctgtgccccttcctagtaccaccagcaacc
atcaatcccgtctcctcctgcctcctctcctgcaatccaccccgccacgactatcgccat
g
```

Homo sapiens NMD3 homolog (S. cerevisiae) (NMD3):

(Seq ID No: 686)
```
tcttctctgtggcggagacagccaggttggcagctgacgggacagccggggtc
tatttgttgcgggttttcagcaaatccagggctggtctggaggcgcgaaaact
taaggcatacagaacgatg
```

Homo sapiens ATPase, H+ transporting, lysosomal 50/57 kDa, V1 subunit H (ATP6V1H):

(Seq ID No: 687)
```
gcgcctctgtcattc
tactgcggccgccctggcttccttctacctgtgcggccctcaacgtctccttggtgcgg
gacccgcttcactttcggctcccggagtctccctccactgctcagacctctggacct
gacaggagacgcctacttggctctgacgcggcgcccag
cccggctgtgtcccggcgccccggaccac
cctccctgccggctttgggtgcgttgtggggtcccgaggattcgcgagatttgtt
gaaagacattcaagattacgaagtttagatg
```

Homo sapiens DPH5 homolog (S. cerevisiae) (DPH5):

(Seq ID No: 688)
```
gggccttttctctgcacggagccggcgcttttgcagttgcttctgcg
gaaaggtggtagttaagaatttgtaaaggccagagaactacctacgattctctcag
cggtctctcttctcctcaagtttgaaatg
```

Homo sapiens polymerase (RNA) I polypeptide D, 16 kDa (POLR1D):

(Seq ID No: 689)
```
cctcctccctccttccgtcctccgcgccttccgtcggtcggtccttgcttcctgcttcgc
ctccgcgcctcgcgctatgggacagagcccccgatccgccagcaccacctgaggatcca
gaaaccgcccagcgatg
```

Homo sapiens HMP19 protein (HMP19):

(Seq ID No: 690)
```
ctgtcctttcagcaccacaag
ctcgggctgaggagggaggactcctggccgtcctcctcctcttcaaattggctt
gaatcttctctgaccccccacgagtgcagcacagtctgggaagaaaggcgtaaggatg
```

Homo sapiens adiponectin receptor 1 (ADIPOR1):

(Seq ID No: 691)
```
gcgcccttccggcgcggggagggcgct
gaagatcggggccgctcggccgcaggccgcctccagcgccgcgggatgtagcgcgggg
gaccgcggccccagcagagcccgcctgcccggcttgtctaccatcagagggaga
```

-continued tctctgccccctggggctgagagaccccaacctttccccaagctgaag
ctgcagggtattgaggtaccagccagatg

*Homo sapiens* SH3-domain GRB2-like endophilin B1 (SH3GLB1):

(Seq ID No: 692)

ttttcccttgggacccgggtccacacggcggggtcgcccgtccatctccggctcgcccgc
ggggccatcgtcgacgttagcggccgttctccgagccgactgacccatccttggcgctg
ccgccgcgcgcttgttctcctccctcgccccgccttcatcctcccgttcacggaaacga
cagctgcggctgcgggctggcgccgcctcctccacctaccacgtctgccctcgccgct
ctagccctgcgcccagcccggccgcggcacctccgcctcgccgccgctaggtcggccgg
ctccgcccggctgccgcctaggatg

*Homo sapiens* anterior pharynx defective 1 homolog A
(*C. elegans*) (APH1A):

(Seq ID No: 693)

gtccctcttcggcttccgtagaggaagtggcgcg
gaccttcatttgggtttcggttcccccccttccccttccccggggtctggggt
gacattgcaccgcgcccctcgtggggtcgcgttgccaccccacgcggactcccag
ctggcgcgcccctcccatttgcctgtcctggtcaggccccaccccccttcccacct
gaccagccatg

*Homo sapiens* RNA binding motif protein, X-linked 2 (RBMX2):

(Seq ID No: 694)

ctgcctttcccgggcgctgattcctgagtgctgagcgcgaacccgaggagatg

*Homo sapiens* family with sequence similarity 82, member B
(FAM82B):

(Seq ID No: 695)

atctcctttagccccgcccgcctccgtagctgcct
gaagtagtgcagggtcagcccgcaagttgcaggtcatg

*Homo sapiens* UTP11-like, U3 small nucleolar ribonucleoprotein,
(yeast) (UTP11L):

(Seq ID No: 696)

tgatcttttccaaggctgtacagacatg

*Homo sapiens* chromosome 14 open reading frame 166
(C14orf166):

(Seq ID No: 697)

cgccctctcgccgcgtcgccggtgcctgcgcctcccgctccac
ctcgcttcttctctcccggccgaggcccggggaccagagcgagaagcggggaccatg

*Homo sapiens* transmembrane emp24 protein transport domain containing
5 (TMED5):

(Seq ID No: 698)

gcttctctttcggagggagtgttcgccgccgccgcggccgc
cacctggagtttcttcagactccagatttccctgtcaaccacgaggagtccagagag
gaaacgcggagcggagacaacagtacctgacgcctcttttcagcccgggatcgccccag
cagggatg

*Homo sapiens* coatomer protein complex, subunit zeta 1
(COPZ1):

(Seq ID No: 699)

gtttcttttgcggctccacgtcggcaccagctgcggggcaagat

*Homo sapiens* mitochondrial ribosomal protein S16 (MRPS16):

(Seq ID No: 700)

ggttctttctgtgtttgttctctgccctgccaaggccgtagag
ctggtgcgtgcgggtagcgggctctccgaggagccgcacgccggcggcaccatg

*Homo sapiens* charged multivesicular body protein 3 (CHMP3):

(Seq ID No: 701)

ctacctccttttccgcgggccccgcccaggcggctgcccgtgacctgcctgggcgcggg
aactgaaagccggaaggggcaagacgggttcagttcgtcagtggggctgtttggaaagacc
caggagaagccgcccaaagaactgatatccaaagagaagaagaaaaagtgaaacgatctg
tgaaagatgctgccaagaagggccagaaggatgtctgcatagttctggccaaggagatg

*Homo sapiens* RNA binding motif protein 7 (RBM7):

(Seq ID No: 702)

cgacctttggccaggttagggaggggcgacgctgagatg

*Homo sapiens* eukaryotic translation initiation factor 3, subunit
L (EIF3L):

(Seq ID No: 703)

cgctcttttccggcggtgctcgcaagcgaggcagccatg

*Homo sapiens* zinc finger protein 706 (ZNF706):

(Seq ID No: 704)

ccttcctttccctccggcgtcctctcccggcccctctcgcgctgcac
tgtctctccgacgcaagactgtcccggcccggatatg -continued

*Homo sapiens* androgen-induced 1 (AIG1):

(Seq ID No: 705)

cgccctccttgccgcccag
ccggtccaggcctctggcgaacatg

*Homo sapiens* interleukin-1 receptor-associated kinase 4 (I-RAK4):

(Seq ID No: 706)

cgccccttcgcggcgcttcctagttcggctggttcttctgtcgccggctt
cagcagcccgcgcccgggcaggaatagaagatg

*Homo sapiens* transmembrane protein 66 (TMEM66):

(Seq ID No: 707)

cgttccttcgccgccgccaggggtagcggtgtagctgcgcagcgtcgcgcgcgctac
cgcacccaggttcggcccgtaggcgtctggcagcccggcgccatcttcatcgagcgc
catg

*Homo sapiens* carboxypeptidase Q (CPQ):

(Seq ID No: 708)

ccgcctctcggccccgcggcctggccggcaagcagggctgcagtcacggggcggcgcg
gagggccccagcccagtcagggtgtggccgccgccaccgtaaggctaggccgcgagct
tagtcctgggagccgcctccgtcgccgccgtcagagccgccctatcagattatct
taacaagaaaaccaactggaaaaaaaaatg

*Homo sapiens* hydroxysteroid (17-beta) dehydrogenase 12 (HSD17B12):

(Seq ID No: 709)

cgctcttttcattcacgaaggtagtgaggcctagtggaaagccatg

*Homo sapiens* protein phosphatase methylesterase 1 (PPME1):

(Seq ID No: 710)

cctcccctcgatg

*Homo sapiens* HemK methyltransferase family member 1 (HEMK1):

(Seq ID No: 711)

cccccttccggcaggctactgggctccgcccacacacctcccggcctggttcctaaacg
ccagctcggagcaatcccttgggctggagccaaatccctgctgtgattttaaggaagac
cggcaggtccgggcccccaagggtcaaccccacacacatccccgcactttcctgtatgca
ggcctgcgagcgtagagggagtggaattcacagcctcccacccatccgcagggtctcc
tgggaggaacccaccagcgataggaacactgaagctgggctacggcgtccgcccgagcct
tttcttaaaggcgccgaccccggaagcggggcgtccgagggagcgcgcgacgggccacgc
acgtccgggcgtccagttcggggcagcttctccggctggtgggtgggtggggcagccttt
caggcagggtggcaaccaactatatctgaggaccagagccatttttggggcaccagagctt
gtgacctctccatctccacccagctgggtccaggggccactctcagcactcacctcagca
gctgacatcataaagcagacttgggaacctggaagcactctggagaacctttccctgaga
catg

*Homo sapiens* N(alpha)-acetyltransferase 38, NatC auxiliary subunit (NAA38):

(Seq ID No: 712)

cgcccttcagttctgcttgctgtcggcaccgctgcgttacccg
gaaccgccgggccgaacagcatg

*Homo sapiens* cleavage and polyadenylation specific factor 3, 73 kDa (CPSF3):

(Seq ID No: 713)

ggttcttcctttttttatttaccggtggctgtgcttccaatttag
gaagaccccggcgaccgttcctcaccccgcttcgccctcacactttcgggatg

*Homo sapiens* dynactin 4 (p62) (DCTN4):

(Seq ID No: 714)

tcgcctcctccctcccccaa
gatg

*Homo sapiens* hydroxysteroid (17-beta) dehydrogenase 11 (HSD17B11):

(Seq ID No: 715)

gttcctccttgctctcgcccctactctttctggtgttagatcgagc
taccctctaaaagcagtttagagtggtaaaaaaaaaaaaaacacaccaaacgctcg
cagccacaaaagggatg

*Homo sapiens* YTH domain family, member 2 (YTHDF2):

(Seq ID No: 716)

tag
tctttccaggtgttagtcgaaac
ctcgtggtgcgaccctggtcgtcccaaacccctaggccttaatcctggggcggtgggggg
cggggaggccgtgagcacggcttccgctcctccaatccgccagagggcg
cagcggccggcctctcccttccgggggttcttcgcgccgggcccttccgcgtgggtgag
tgaatgtgagag
tcagcgctcgccgccgcgcgccgcccgcctccgctgttcggcgctctgctttaggcggt
gggggcgggcgcgcgcgtaaaagcatagagacgggcattgagctcttgggcta -continued

```
gagcgtcgccgagtcggagccg
gagcctgagccgcgcgctgtgtctccgctgcgtccgccgaggcccccgag
tgtcagggacaaaagcctccgcctgctcccg
cagccggggctcatctgccgccgccgcgctgaggagag
ttcgccgccgtcgccgcccgtgaggatctgagagccatg
```

Homo sapiens tubulin, epsilon 1 (TUBE1):

(Seq ID No: 717)
```
agctctctag
cagagcgccgttgctgggggaatgcagaagcggccgcgggctagcaagctcccg
gagccggcggcgcaccaccatg
```

Homo sapiens ubiquitin interaction motif containing 1 (UIMC1):

(Seq ID No: 718)
```
cctccttttcttcctcagcgggtccgcggcccgctactctccgggaggggcgcttcccga
cgccaaggtaggcctctcccgacgccggggcggcccttcctgatgccggggtgtgtctct
cgcgacgcgggggtgggctccggacgccggggctggccttgccgaagtcggggtgggtc
cctccggacgccgaagtgggctcgggatgcggggctggaccctcccgattccgggcgg
attccggacgccgggaccggccattactggtgccgggttgggcttctccagatgccgggg
ctgggtccttcccaaggttgagacaaaaggatg
```

Homo sapiens TNF receptor-associated protein 1 (TRAP1):

(Seq ID No: 719)
```
ccgccccttcccatcgtgtacggtcccgcgtggctgcgcgcggcgctctgggag
tacgacatg
```

Homo sapiens cereblon (CRBN):

(Seq ID No: 720)
```
cagcctcctttgcgggtaaacagacatg
```

Homo sapiens ribosomal L24 domain containing 1 (RSL24D1):

(Seq ID No: 721)
```
cttcctctcaagcttggcgtttgtttggtggggttacacgcgggttcaacatg
```

Homo sapiens leucine carboxyl methyltransferase 1 (LCMT1):

(Seq ID No: 722)
```
taccctcttctgtt
gctttctccctgtggctcgcgccgtccccgccgcccgtcgaccccgcttccatgtccct
ggcggacacagctcccaggaacctccacgcccatggccactaggcagagggaatcctc
tatcacctcctgctgttccacctcgagctgcgacgcagacgacgagggcgtgcgcgg
cacctgcgaagatg
```

Homo sapiens RAB14, member RAS oncogene family (RAB14):

(Seq ID No: 723)
```
ccccccttcttttgtggtccggcccattgcgagggtgacaggaaaccctgtg
cagggagcgccgccatcttggaccagcccgaggaagatactgagggagcacaggagcag
tcaccgctgccactgctactgccgctactgctgccggcgcgtctgcac
ctctcggcctgccagtgtacctgccggcgcctcggtcgac
cgccccgccccctctcccgctgcgtccgcactcctgttcctggtcctgac
gcccccctcccgcccggaaaagctgcccagccaccagcaaccccccagtgccaccatg
```

Homo sapiens Enah/Vasp-like (EVL):

(Seq ID No: 724)
```
cttccttttcctgttt
ggttttaagtaggctataaaaatcaagtt
gctgtcttcagagggtctgtggtcctctgatcaacataggctggtgggagtacag
gactcgcctcctcagggttccctgtgctgccacttttcagccatg
```

Homo sapiens LIM domain and actin binding 1 (LIMA1):

(Seq ID No: 725)
```
ctctcttcccctctccctctccctctgccgggtggatgctttctccatgtgg
caaggctgtaactgttcacagctgtctgaaacagcagtggaccaggagcagcttggag
ttttaactttcattttacaaagaacaacatgtttgaatgtttcag
caggcaagttataactggcatctacttcttgttcttctagaacac
cgaaaatctctcccagcactttagaaaggggacccctgactgtgttaaagaagaagtgg
gagaacccagggctgggagcagagtctcacacagactctctacggaacagcagcactga
gattaggcacagagcagaccatcctcctgctgaagtgacaagccacgctgcttctg
gagccaaagctgaccaagaagaacaaatccaccccagatctagactcaggtcac
ctcctgaagccctcgttcagggtcgatatccccacatcaaggacggtgaggatcttaaa
gaccactcaacagaaagtaaaaaaatg
```

Homo sapiens ubiquitin-fold modifier conjugating enzyme 1 (UFC1):

(Seq ID No: 726)
```
gtttctcttgcgccctggtccaagatg
```

*Homo sapiens* coatomer protein complex, subunit beta 1 (COPB1):

(Seq ID No: 727)

caccccttccacgtcagccaaggactctggagccgccgccgcgctgctgcggttcata
gccggagtagacggagccgcagtagacggatccgcggctgcaccaaaccactgcccctcg
gagcctggtagtgggccacaa
gcccccagtcccagaggcgtggtgggtcgggcagagtcggaagaactggctttctagctg
gaagatgcggaaggggagcgactaggccgcttgcgtctgggcctggcagaagggaccgga
ttttctggcatccttaaatcttgtgtcaaggattggttataatataaccagaaaccatg

*Homo sapiens* transmembrane protein 9 (TMEM9):

(Seq ID No: 728)

gggtcttttt
gcggctgcagcgggcttgtaggtgtccggctttgctggcccagcaagcctgataagcatg

*Homo sapiens* shisa homolog 5 (*Xenopus laevis*) (SHISA5):

(Seq ID No: 729)

ctttcttttctccaaaaggggaggaaattgaaactgagtggcccacgatgggaa
gaggggaagcccaggggtacaggaggcctctgggtgaaggcagaggctaacatg

*Homo sapiens* transmembrane protein 69 (TMEM69):

(Seq ID No: 730)

gtgcctttccagtggacctgggctgttgttgcggttgttttccttctctccgtgcaac
gctggcaagtctcaaagtcgccacagaaacatgcccctgattcag
tgcctctgcttagctgtaacatgttaatcagaactacctggcatcttcctgaacaa
gactttcaataggggccagtatg

*Homo sapiens* kelch repeat and BTB (POZ) domain containing 4 (KBTBD4):

(Seq ID No: 731)

agatcttcttccgggcggacgtggagccggaagcggaggttccgggctc
cgggatg

*Homo sapiens* pipecolic acid oxidase (PIPOX):

(Seq ID No: 732)

cgtcctttagccgg
gagcctgtctttgcttgcctttgcctttgaggctctgtggctgtggggctgagtggcat
catg

*Homo sapiens* blocked early in transport 1 homolog (*S. cerevisiae*)-like (BET1L):

(Seq ID No: 733)

agctctttccccgcgactgcgccac
gtctgaggcggctgtggccgcgtcggtgtccgcgtcgaggagccggggcagggcacgatg

*Homo sapiens* zinc finger protein 581 (ZNF581):

(Seq ID No: 734)

ttctctctttcggccggcgccgccagttcctgggg
cacacccagaggtccccttctcgccgccgcctgcaactgcgaggg
tagcccggggccgcttggagtcgcccggacctgagaggctgctgcac
tgggcctcagccagccctccggatg

*Homo sapiens* armadillo repeat containing, X-linked 1 (ARMCX1):

(Seq ID No: 735)

cgtccttctaatcctagtcttcgtttggtccggttgcactcttcctatagcccagagggc
gagagggcctgtggcctggggaaggaggacgaggttctgcctggatcccagcagtagga
cgctgtgccatttgggaacaaaggaatagtctgcctggaatccctgcagatcttggggcc
ggaggccagtccaaccttggagcaggaagaaacgcaaagttgtcaagaaccaagtcgag
ctgcctcagagccggccgcagtagctgcagactccgcccgcgacgtgtgcgcgcttctc
tgggccagagcgagcctgttttgtgctcgggttaagagatttgtcccagctataccatg

*Homo sapiens* spastic paraplegia 21 (autosomal recessive, Mast syndrome) (SPG21):

(Seq ID No: 736)

cggcctcccgcacgcaccgcgcagcctgctgtgcccgtgggtcccgag
tgctccgccgcccgccccgacccgggcccagccgcctccacggcccgcgctcgtactg
gagcgaagagcggcctcctgaaggaggggaagggacgtgggggcggccacggcaggat
taacctccatttcagctaatcatg

*Homo sapiens* staufen, RNA binding protein, homolog 1 (*Drosophila*) (STAU1):

(Seq ID No: 737)

tctcccttttttccttcttccttccctcctcgccgccac
cgcccaggaccgccggccggggacgagctcggagcagcagccagagtttattaaccac
ttaacctctcagaactgaacaaagacaacattgttcctggaac
gccctctttttaaaaagaaagcataaccctactgtagaactaaatgcactgtgcatg -continued

*Homo sapiens* adducin 2 (beta) (ADD2):

(Seq ID No: 738)

cggccttttgtcagcgcg
cagggccaggagagctctcatttcctcccagcctcgtgcgg
gaaatggctttaattctgacggcagggctgtgagggactagcgggaacccgagccttt
gtcaaggaactgcggcgtcggtggccagtcatccccgccgccgcggagccgctgcac
tgctgggggatctcccagcagctctgacgagcgcgggctgcagcatgggcagaaaac
gctgccctgcagattagctgggtggatttttttaagcgcaccccaccccccaaaccca
taaaataacaaaaccaacccgcagtggccgaccggagatagctaagatgccgcgcag
gagtttccacctggatgtttgaggttgtgtagatgtggccggcacccttgagagtg
gagctagggggtgcagactgagcagtgaacagaaggagcctt
ggacagggctgggccagcctcccgagttccaggagcgaattgcaaacccaccgg
gaaaatg

*Homo sapiens* WD repeat domain 1 (WDR1):

(Seq ID No: 739)

ccgccttccggctccag
tccccgggctcggcctcggcgaggtgtaattcgcagcgcgggccggccccg
gaggctctcggcgagcgcggcgcggtaacaagtgggcgaggatg

*Homo sapiens* family with sequence similarity 20, member A (FAM20A):

(Seq ID No: 740)

cgacctctacttccac
ctctggccccaagtacagcgccagctgcggcctcgggagcgcccgcgggggtgcccgtg
caccggccgcgcctcctccctggcgcgggactcggccgcagctgcctcggaccccgg
cacgatcgtgcacaactttcccgaaccgagcccggactgaaccggctggcgg
cagccacagcgggtcgagctccaagttgcaggccctcttcgcccaccgctgtacaac
gtcccggaggagccgcctctcctgggagccgaggactcgctcctggccagccag
gaggcgctgcggtattaccggaggaaggtgggcccgctggaacaggcctcag
ttcctgcttttgaaaggaagagggggagtctgtgaccccgaggcctcctt
gcaactctgttttccaagctttgcacatcttccgaatttcttcttcaaagtc
taccctaatgaaatatcagacaattttccaagtgtgcttcatgaacttctgg
gaggtgcttcacagtttctgcaaatgattgattgaattttcactttgaaaaaa
tatactttaaggcgacacaagatg

*Homo sapiens* kelch domain containing 4 (KLHDC4):

(Seq ID No: 741)

ttttctttcctggtgtcccgtcgcggcttgggacccggcaagatg

*Homo sapiens* calcium channel flower domain containing 1 (CACFD1):

(Seq ID No: 742)

tgctccctctcccacaaggcagcgcgccggctcggacgcggccggctac
cgagccctttgtgagggctgtgagctgcgcctgacggtggcaccatg

*Homo sapiens* zinc finger, CCHC domain containing 8 (ZCCHC8):

(Seq ID No: 743)

gaatcttttccacagcccaaaatg

*Homo sapiens* kelch-like 24 (*Drosophila*) (KLHL24):

(Seq ID No: 744)

gtttcctttt
gttgtgagctgcggcagagactggtggctggaggagacgccggcgctggagag
tgcgctgcgccgcccgccgctgagggaccgcggggttagccactgctggctgcttccag
tgttcgccgagaggtaccgggggtgacagctccgggaccggccgaaaggcgaggaac
cggtgtggaaattaaaagaacacacatatttttgactgggctttgatcaac
caaatgctaaaaagccacataaagaagatccctaatagtcatttctcaacaattata
tagtcaactgatgtaacaatg

*Homo sapiens* FtsJ homolog 3 (*E. coli*) (FTSJ3):

(Seq ID No: 745)

ctcccccttttccaccatg

*Homo sapiens* dymeclin (DYM):

(Seq ID No: 746)

gcttccctcttctctcgccgcctcctggcctccgcaccgacgcggcccgggctg
gagccgagccggggccgagctgcaggccggaccggagccggatctgtaccgctgagac
gtggaaacatggaggcctgagccggtgtgcgccac
ctgggctgcggcggcgacagcgacttctcctgaccctctgccaccctcccatccgtccg
cgggtccgtggagctggagcagatcccccagccggctgagacaggttgtctttt
ggaaatgcaggtttaaggacaaattatctgcttaagctagaagatg

*Homo sapiens* zinc finger protein 280D (ZNF280D):

(Seq ID No: 747)

cctcctctttctcctcctcctcagggctccagtcaggccgatccgctccgctcac
ggaaggaaaacagaaataacttgctggcttgtctggag
tcacatgtacttaggtgacaatttacagaaagtcatctctgcagcttgatg

*Homo sapiens* ankyrin repeat domain 10 (ANKRD10):

(Seq ID No: 748)

cgttcctttt
gtgctgcggcggcggcttctcgagtcctcccgac
gcgtcctctaggccagcgagccccgcgctctccggtgacggaccatg

*Homo sapiens* SWT1 RNA endoribonuclease homolog
(*S. cerevisiae*) (SWT1):

(Seq ID No: 749)

ctctcctttggcttggggctccggagttgccac
tgccgccggcgctggtaagcttttcaggatg

*Homo sapiens* leucine rich repeat containing 49 (LRRC49):

(Seq ID No: 750)

tgacctcttctcgggtctctttgaatctccgctgtagcgtcacctggaaggcagatctaac
agagaacctggactgtctcctatcatg

*Homo sapiens* F-box and leucine-rich repeat protein 12
(FBXL12):

(Seq ID No: 751)

ccgccttctggacttggtcttagttcccagtcgcggccaaatcac
gcctcagccacctcccgcaagcctctcactgcctcagccacgcttttccaggctggttctt
ggtccccatccgcggctggtccggccctgggaccgaatcacttcccagcgagaggaaggt
caaatttctcgaccggctacgggaaggtcgcggccgccgccctgtcagccgcctcggcgc
ccccaggaccccctcgggtctctttaaccggaagcggaagtgcgtgtcggcgggatcatg

*Homo sapiens* WD repeat domain 55 (WDR55):

(Seq ID No: 752)

cagtccttctcagcatg

*Homo sapiens* zinc finger protein 3 (ZNF3):

(Seq ID No: 753)

cgttcctttt
gttctgtccccggtgtgtgggtctgtgacagggtccaacagggcctggtccgtgtccggt
ccccaaatctgtcgtccctgcccccaggcattgg
catcaacaaaagtcagaattcccgggaacttgaacagaggctgctaaattcccag
taattgctcctttggccttctagggactgacttcaaagaaggaaggaaa
gaatcaggcagtgcttcctcattctcttttaaaacccgcttcccgctgagtctg
cacccaggagaccagagagcaccttgcccttccatg

*Homo sapiens* tetratricopeptide repeat domain 27 (TTC27):

(Seq ID No: 754)

ggttcttctcctaggcggaagccagaccaga
gagcgtgcgtgttttttcccaggggtgccccgcgctgctgttatggccgcctcctt
gaggtagtatccgcacatggaattctagggccgcaggtgtatttacgg
taactgtcgccactagatttcagcgcctttggactctcctgttttcactttcttttgtt
gactcccgtgtggccctcgtgggagcctgttttggctgcagcggtgtctggggtgatg

*Homo sapiens* THUMP domain containing 1 (THUMPD1):

(Seq ID No: 755)

gtttctctttcctctcagtttgcgcacaccatg

*Homo sapiens* ankyrin repeat and KH domain containing 1
(ANKHD1):

(Seq ID No: 756)

tgctcttctcgttcccgagatcagcggcggcggtgaccgcgag
tgggtcggcaccgtctccggctccgggtgcgaacaatg

*Homo sapiens* syntabulin (syntaxin-interacting) (SYBU):

(Seq ID No: 757)

cctcctcctggacggcggcagcggcggcgcgaggagccggcgggcagcggcgcgatg

*Homo
sapiens* coiled-coil-helix-coiled-coil-helix domain containing
3 (CHCHD3):

(Seq ID No: 758)

gcgccttctccttgcttctgggggtcgtggcctt
gctcccgctgtgcgggaaaagaatccaggcccttccac
gcgcgtgtgggtgcgggggccccgaagtgctcgtggttccccgctaggtctccgctgggg
caggaaccggaatcatg

*Homo sapiens* HAUS augmin-like complex, subunit 4 (HAUS4):

(Seq ID No: 759)

cctcctcgtcgcggcctctagtgcactttcggctccttccccttcccgggcctttcagc
ttggtctttccgggcctcgcttcccccagcccctgcgcccggcccgaacgagaggttccg
gagccccggcgcgggcgggttctgggtgtagacgctgctggccagcccgccccagccga
ggttctcggcaccgccttgagagcttcagctgccccaggattagaatcccaagaaaatca
aatg

*Homo sapiens* solute carrier family 41, member 3 (SLC41A3):

(Seq ID No: 760)

ccgcctctttcccgccgccgcctgggaggg
gacccgggctgccaggcgcccagctgtgcccagatg

*Homo sapiens* phosphatidylinositol glycan anchor biosynthesis, class V (PIGV):

(Seq ID No: 761)

cttcctttccagcctcccgccctcgtctgcttccggccctgtggcctggtggggctctg
caggctccctcgggagtggtccttgggccgtggccctctgg
gaggcctgagggagctcaatcctggtagcaacacccctgaattcctggtggtgaaag
gatg

*Homo sapiens* poly (ADP-ribose) polymerase family, member 16 (PARP16):

(Seq ID No: 762)

agttcctttatccctgggcccaac
ctccccgccgacccgcggtccaggcctcggtctctctcttcggcggcgagccgcggccca
gacccggcagaggacacttgtcggcac
gttctcaccccgtcatctcagccccctgcctagctccaccccaggcttgg
gaacccggcccctgacggcccattgtccgcgggcccagccccgcgctgaacgcac
gctcgcccttgcccctaaccagcgcgtctaccccggcaacgcgcagtgacctgggatg

*Homo sapiens* thioredoxin-like 4B (TXNL4B):

(Seq ID No: 763)

gtttcttttctgcgcttgtgcgttttctgttcggtttccttcccgctagcggggccac
gaggggttgctaggcaacagcccctgggtgacttggtcttagggtcctgtccggctt
ggggctgatgaaaggagctgtccgcgcccgggctcttccgagaagtggtt
gctgacagccacaaagtgaaagggagtgaggcggcgtggacgagtaaggagtgacag
tgaggattcacatttgggttatttcaagatg

*Homo sapiens* slingshot homolog 3 (*Drosophila*) (SSH3):

(Seq ID No: 764)

cgtccttcctggtcctgcgggtccaggactgtccgcggggtt
gagggaaggggccgtgcccggtgccagcccaggtgctcgcggcctggctccatg

*Homo sapiens* zinc finger protein 692 (ZNF692):

(Seq ID No: 765)

ctccctctggggcgcgggcctcagttccgggctacagcagccgacgccgagaggcac
cgtttcttcttaaaagagaaacgctgcgcgcgcgaggtgggcccctgtcttccag
cagctccgggcctgctcgctaggcccgggaggcgcaggcgcaggcgcag
tgggggtgagggcgcgtgggggcgcacagcctctggtgcacatg

*Homo sapiens* tRNA-histidine guanylyltransferase 1-like (*S. cerevisiae*) (THG1L):

(Seq ID No: 766)

tggccctttcctttccgcgtgtagaatg

*Homo sapiens* solute carrier family 25, member 38 (SLC25A38):

(Seq ID No: 767)

tctccccttctacagagttcctccggcgcttcctccaccccgggatacacagaacctcat
ctcctacggtgctgaagcctgcagcagggcaggatgggcaggagagcagagccgcggagt
ctgcggcgcgggtgaagagcggcgcgtaattcccgcagcaagattgttccgcgcccgcag
cccctggactagcaggatccgaaccccggcggctgcgtgcttataggcgcagacgtcaga
gagcccgcggcttaaagcgcgtcgcctggctagcgccaccccctagccttcttcaaggcc
tccaggctgggcccaagcgcccgtcgacggcaccctgggcccagaggactcgcgggcct
catctccaatg

*Homo sapiens* WD repeat domain 13 (WDR13):

(Seq ID No: 768)

agttctttctga
tagcaggcagccatcttgcctggagcctgagaaagggaggagagacagaaggaac
cggcgacagtggtctcaggcgcctccgggggcctcaagaaccggaggcagccccg
gaggtggtccccgatcccgggctatgctcttggatctgagaagggaaggcg
gagggcggcgggacaagatgggtggagaatgtcaagcaaggaatgctaggcgggg
gagggcgttgctatggcgactggg
gaggggcggtgtctgttctgaatcgctgtgtgtcacccgggcgctgcccaggaaggg
cagggctggggtgatgaccatggtaacacccggggggag
ttcgtgacatctccggcgcggagggactcgatgtctatggcaatggtcgcctggtg
gaagggacggaactagatcccttcgctcggacgctcacattccaggcccttgtcctg
caggctgccgcgggcggacacgccagaggaggaggccggggaatg

*Homo sapiens* chromosome 1 open reading frame 123 (C1orf123):

(Seq ID No: 769)

ccgccttttacgacgcgccggaaagcaacggcaagggcggcagccagcaccgggcgga
gagggctaccatg

-continued

*Homo sapiens* chromosome 20 open reading frame 11 (C20orf11):

(Seq ID No: 770)

ctgcctccttctactcgggcgccccggcggccgccacctctccccagcccagga
gaggctgcggagccgcagccgcccagaccgcgcagcgcgggaggcaggttccgcac
gaaataaatcagaatg

*Homo sapiens* zinc finger protein 446 (ZNF446):

(Seq ID No: 771)

ttccccttt
ggggacagatcccgaagttcgagcatccctcgga
taggccgggtgtcaggcctggtctctcaggcccgtccaggcccatcttgacgattccaa
gaccaccccttgagcaagaatg

*Homo sapiens* mitofusin 1 (MFN1):

(Seq ID No: 772)

ccgccctttgccac
tcccctgcctcctctccgcctttaacttctcgggaagatgaggcagtttgg
catctgtggccgagttgctgttgccgggtgatagttggagcggagacttagcataatg

*Homo sapiens* phosphotyrosine interaction domain containing 1 (PID1):

(Seq ID No: 773)

agtcctctcgcagctgcgccaggacagccggcgcgcggccgtgcccacaagttgccggca
gctgagcgccgcgcctcctcctgctcgcagcccctacgccacccggcggcggtggcca
gcgccaggacgcacatcccgcggacaccgaccccagatgtaaagcgggaccccagcccct
cgccccccggcgcgatcgacagtctcgccagcgtctcctctgccaaaacccaggggctgga
agatgtggcagccggccacggagcgcctgcaggagagatttgcagacacagaagcggcac
agagaaggccattgtgaagatcaaggcagaaaccggagttatggcatcataagccaag
gaatg

*Homo sapiens* pleckstrin homology domain interacting protein (PHIP):

(Seq ID No: 774)

tttcctcctcctcctcctccgcctccgccgccgttgcttgaatggtggagccgaagctcg
gctcgtgaacacacactgacagctataggcaggcggcggcaccgtccccgcttcccctc
ggcggcggggtgtcccgtcggcggccctgaagtgacccataaacatg

*Homo sapiens* LIM and senescent cell antigen-like domains 2 (LIMS2):

(Seq ID No: 775)

tggccttttt
gggcgtctccctgctccgcgggcccgggctggcggcgggcgctcggctggcggctgcag
cagcagagggagacccgcggcaaccccggcaacccagggctcggcgtcgctgccaccatg

*Homo sapiens* SCY1-like 2 (S. cerevisiae) (SCYL2):

(Seq ID No: 776)

aggtcttttag
tcttttccccctcccttactcttcgtccccggtccctccctccccacccctttccttc
tagctccgacgtttgcggccgcggggcggcggaggatatggagtaaagccagagtcag
tggccaggcacgaaggcagagcaggaacagccaggaggcgtttattagggggcgggg
gaaagagccccagcaccgcccctcctggaagaaggaagaggtaagtgaccggccgccgg
caccgaccgacctccctcaccggcggctctctcgcctgggctcccggagccggcgag
gagggaatggag
gactcgcgcccgggttaggcctcccagggccgctcaggctggtgggtgtt
gcctggtgacgggcctgccggcggccggccgggcgatcggcggtcggcgcccgcgcaaa
gcggggctggacgagcagcgagctccggggagcggatccgagagggccgag
tcctcgaaagaggccttgaggcgacgggagacccgggatcgaagtcagctgccg
gagggagagccccccatgccggctcgagagctcgggtttcggtggtggagaacgtag
tacctttcggggacattggacactactctaggaccgggtaactataactacccaa
tattgcagccatg

*Homo sapiens* ring finger protein 31 (RNF31):

(Seq ID No: 777)

caccctctctcctagtacttcctgttctcggctaaccctggcgctgggccgggggctg
gagagtgaccgtggtctgagtgacctgggcggctgcgtgggccggggtgggcctcaaa
gccgggcaccagacgg
gaggggcggcgctcgggccgcgcgctgcccgcgccgggtcctggcgggcggcgaggctgg
ggctgactcctgcctcaggatg

*Homo sapiens* mediator complex subunit 9 (MED9):

(Seq ID No: 778)

cgac
ctctggctaacctaccccggagccatg

*Homo sapiens* ATP5S-like (ATP5SL):

(Seq ID No: 779)

cggccccttccggttacgaaac
cttagcaagatg

*Homo sapiens* GPN-loop GTPase 2 (GPN2):

(Seq ID No: 780)

tctccttttgcgcgacacggtctcagctgttccgcctgaggcgagtgacgctggccgcca
acgaggtatacgtactgggaccctcgccctcagtctcgtctccggcgcggctacctgccc
cgttttccctgtgagttgacctgctccgggccgcgggccgccaatg

*Homo sapiens* transmembrane protein 48 (TMEM48):

(Seq ID No: 781)

cggtctcctg
tacgccctagactaggggccgccatctccatg

*Homo sapiens* ankyrin repeat and zinc finger domain containing 1 (ANKZF1):

(Seq ID No: 782)

ttgtcctcttcgctgctccgtagtgacggggattgttgtgtt
gcagaaatccggcaatcgacctgaggacttgcgagccgctcagctcccgggacgttt
ggagctgctgctaaataatttctgctcagccatg

*Homo sapiens* notchless homolog 1 (*Drosophila*) (NLE1):

(Seq ID No: 783)

ggctctttctcctccacgtggggacgcaggatg

*Homo sapiens* cell division cycle associated 8 (CDCA8):

(Seq ID No: 784)

cgctctctctcactggcacagcgaggttttgctcagcccttgtctcgggaccg
cagcctccgccgagcgccatg

*Homo sapiens* polymerase (RNA) III (DNA directed) polypeptide E (80 kD) (POLR3E):

(Seq ID No: 785)

cgctcccccccac
gtgtccgccggagtttctccaccagcaacatggccgccgcctgagagga
gagccgggccgccgccgtctctgcagcccgcgggtaactgggccgtt
gccgccgtccgcgctcggccccccgcggaga
gatcgagctgaaggactgcgcggctggctctcctctagtatg

*Homo sapiens* armadillo repeat containing 1 (ARMC1):

(Seq ID No: 786)

gagccttttgcccgccagcgccttcgctcttttggctccctgagttagtccggttgctt
gcgatcgccgcggccggggctgcgaaccgaagggctcgctccgcgccgcctgggtctc
tacctcatccgtaggtgtggccctgatggtgtggcaggctctggactcctaaagctctg
gagcgaatttaagatttttattcatgtgcatggcatagaagatg

*Homo sapiens* transmembrane protein 33 (TMEM33):

(Seq ID No: 787)

ccgtctttctg
gaaacaccgctttgatctcggcggtgcgggacaggtac
ctcccggctgctgcgggtgccctggatccagtcggctgcaccaggcgagcga
gacccttccctggtggaggctcagagttccggcagggtg
catccggcctgtgtgtggcgcgaggcagggaagccgg
tacccgggtcctggccccagcgctgac
gttttctctccccttctcttctctcttcgcggttgcggcgtcgcagacgctag
tgtgagcccccatg

*Homo sapiens* pyridoxamine 5'-phosphate oxidase (PNPO):

(Seq ID No: 788)

ccttccttcccgggtagaagtccagggtgagaaatt
ggttccgaactcaaaggaaccagtgccgggcacagccgggtcac
gtggccggcggccccccatg

*Homo sapiens* golgi phosphoprotein 3-like (GOLPH3L):

(Seq ID No: 789)

attccttctctgcatcgaaggatcaggaagtttgtgctctctgcgtggctaagttttca
cctactaggacgggggtggggtgggagaacaggtgtccttctaaaatacagcacaagct
acagcctgcgtccagccataacccaggagtaacatcagaaacaggtgagaatg

*Homo sapiens* regulator of chromosome condensation (RCC1) and BTB (POZ) domain containing protein 1 (RCBTB1):

(Seq ID No: 790)

cgctcctcctcttcgctgccggtgggcaccgccgctcgctcgcacttctgcgcccatt
ggagcttcggagatccctgcggtcccgcgggacggcgcggcagcagctgacctcgcaga
caggatcttgctctcttgcccagactggaatacagtggtgtgaacacggctcactg
cagcctcaacctcctggactcagagatgtcggcttatttataggaattgcttgaa
gccagagtcatg

*Homo sapiens* leprecan-like 1 (LEPREL1):

(Seq ID No: 791)

cgtccctttaa
gagcggctggccaggcacggcctccgcctctcagtacgcggagcgccggcggtcac

```
ctggggctcgcggagcggccagatcgcggcggag
tcggcgcgcttccccgagggaaggtgggagaggggacccggacgcgaggtgccccgaa
gccctctcgagcgtaaccgtcccgcgcctctctgaggcggaggatg
```

*Homo sapiens* hedgehog acyltransferase (HHAT):

(Seq ID No: 792)

```
ctgtctctt
ggctcaggcttggaggcctccgagcagcaacatcgtcccaattataccccgttggag
catcttcagatcttccactcttttcacaacgcaatcaaaatcttcgtacccatttt
gcagtagtgatctctgtaagttgcttttacaattcataaagtttattctattt
gatcttcactctaatttacaaagaaaagcagggaagtctatttctgttttacagaggtg
tacagggaggctcacaggggctaagttcacacagtaagccctcgaagctgccagggctg
caaagcccaccctcttccaccgcaccgaactacctcctttcgcctacaaaac
gtaggtggggaccactggtgttggaatgacggcccacctcgag
tttcaggtgacttccactctgcaattaacttgcaggcagccccagacctg
caatgaacacacgggtgggggagagatatgcacgccagggtcagtgggaac
caacagccgaggggtgagcggggctaggggcccccgggccgccggcggggcaaac
gcggttcagaaacgcaggccgcgctctggcccgcccctgcagcagcac
ggcctgctcgccatcgcccggagagcgccgcgggttcccgagtccgggcgcg
gagggcgcgcgggcacggcggcaggggcgtgctcggaggac
gcgcgctgcgctgctcctccaaagggcagctccggggaaagagggtggcgtcccggg
gaagcccgcagccgccgccgatgtcgctgggactcggaagtgccgaaagaggggtgtt
gggaactcgcggcgcgcgtgaacgttgccgtcgccgccgccgggacagcccgga
gaaactctcagcgtaggcatcgggaaccttcgtgccaaggagccatg
```

*Homo sapiens* chromosome 11 open reading frame 57 (C11orf57):

(Seq ID No: 793)

```
cctcctttttctcccaaaccacttcttccccctaccccccgccacgcgaggctgcggcg
cacggtatgggtgtgttttgtgtgtatttgtgtggggagggcgtttggagggaaggttacc
gggagctccgaggccgctggggaacagggatcccggtgacaaagatgggatatttcctc
tgtcttccacttggaaacctcaaccccccgcttcaggctcccagatactttctggggccc
aaccgaaggccgtagccatccaaagcgttcccagcctttctggggagtgaaacttacccc
cggggttcgtcctagaggagcgtgagcgggaatgcccaggtcaaccgggctgtccgaat
tccgccccggctcagcctccggcctcagtccgggagagatctgcctgtcggtctgggc
tgggggaaacgcggcagtggcctgggcacaggtgagggcaggtaaccagtgggaaggc
tgcgttttcacgaaggactcgggtgaagctgcagagctgcctttgagccctgactccttg
gcttcctgggtcggaggagatcttgtaatggagtggttcttcgtctcactagcaagatgc
ctgatttcctcaggatcaagggattgaagaatg
```

*Homo sapiens* high mobility group 20A (HMG20A):

(Seq ID No: 794)

```
agtccttcgccg
cattggggcaaaataatcccttcattttttgtgaaggtaccgtggaaaa
tatttcattttttcttctcaccggagcaattgtaaatgctatgcggtaagaggagttac
ctgtggaaaggtggttaagagattaggtaaagaaaaggaaaggacaccaaaa
taaagtgctgcggaagaatttttgtccagctgtgagacgacgag
tgcgtgaagtgaaggcgattgagaggggctgagggaattgtcctctgtg
gaagggactttcttttggccctaggccccttcctgccctgtcgtcagcagagtctc
tacaaggaagataacggactgtaaaattctataaagcaaagctacacatcacttgacac
catacaccatcttggttacataatgaagagagatg
```

*Homo sapiens* checkpoint with forkhead and ring finger domains, E3 ubiquitin protein ligase (CHFR):

(Seq ID No: 795)

```
atgtctctt
gacagcggcggcggcgcagccggttccgggttcggcgcggggcgggatgtgaatcc
cgatg
```

*Homo sapiens* nucleoporin 133 kDa (NUP133):

(Seq ID No: 796)

```
ccatctcttcccttaggtgtttaagttccgcgcgcaggccaggctgcaacctgac
ggccagatccctcgctgtcctagtcgctgctccttggagtcatg
```

*Homo sapiens* CNDP dipeptidase 2 (metallopeptidase M20 family) (CNDP2):

(Seq ID No: 797)

```
cttccttccaagaaccttcgagatctgcggtct
ggggtctggttgaaagatg
```

*Homo sapiens* oxoglutarate dehydrogenase-like (OGDHL):

(Seq ID No: 798)

```
gcaccccttccgcgcagccccctgacctgcagcctccggacctcgctgcagcgcg
gacccggcccgcccgcccgaatg
```

*Homo sapiens* transmembrane protein 30A (TMEM30A):

(Seq ID No: 799)

```
ccgcctcttccgctctacagcg
gaggtggctgtggcggtggcgctggtggctgcggcggcggcggcgg
cagcggcgctcgagcggttcctgtcagggtcagccggcgggcccctgggtggtccac
ctgcaaatcgcggagcggcgccccagggatcgatg
```

*Homo sapiens* elongation protein 2 homolog (*S. cerevisiae*) (ELP2):

(Seq ID No: 800)

gcgtctcttgtttgtgcggctgaccagttggcgacatg

*Homo sapiens* WD repeat domain 12 (WDR12):

(Seq ID No: 801)

cgttcttttctttgtatttccgcctctcgcctctctctaaaagccgcagttagaggcgag
atttaggaaaaacctctgccgagtgagcctctggttgggaatatgtatgagaaaaaaaaa
ctggcaaggcgttagtcaagcaaagctgaaggcagaggaaatttgatatctggctggagt
ctagaggatttaatgcaaataagatactctgagggcagcgtggcaaaaaaagactacaat
tcccggtggtcacagcgtttgagaagcgatgctttctgagacttgtagtaactaggagct
gtgtttgaactatccaggctcaggacagcctcttgaaaaaaaattttttattaataaagc
ggatttgagtgggatcttttttcctaatcgattacgggcccacacgtatgggaagaattct
aacaatgattaaagggacatgctacctttacgactatccttttctaatcgatgactccta
aatctaggagtaggtagtcgatgtttgtggtctgggcgtctgtagaagggcaacctcgtg
ctttctgcagaggagaccggagggcagaaggcagagtccaggcttagactgcagttcctc
gcttacctgtgcagtctaattttgagctgcctctttgtagtcttaaaaggcaggagcttc
gtgttgtgggtctgctaacccgtacgtttccgtgggcaagtcgtgtgtactcctcgc
catg

*Homo sapiens* tetratricopeptide repeat domain 17 (TTC17):

(Seq ID No: 802)

cgacctcttcaagatggcgggcgccgga
gactagcttccgcttccggtgtgagcggcccggccggggggcaagatg

*Homo sapiens* proline rich 11 (PRR11):

(Seq ID No: 803)

ttttctttatggcgtggga
gaggccacagcccggactccatcgactcccccggctcttagactaaaatcatg

*Homo sapiens* TBC1 domain family, member 23 (TBC1D23):

(Seq ID No: 804)

ctccctctttcttccctctggggaagctcagtgctggacttccgaagaccttttac
gacattgagtctcggagttggtctcagcgccggatccacttttcggcaaagtgacgtg
gacgtcaacagcaatg

*Homo sapiens* leucine rich repeat neuronal 3 (LRRN3):

(Seq ID No: 805)

gctcctctctggggagtggagggtgttcagttattaatgaccgctgagcaggcagcac
catgtcagtgtgacaactgatcgggtgaacgatgcaccactaaccac
catgaaacaaggaaaaataaagccagctcacaggatctctcttcactggattga
gagcctcagcctgccgactgagaaaaagagttccaggaaaaagaaggaatcccggctg
cagcctcctgccttcctttatattttaaaatagagagataagattgcgtgcatgtgtg
catatctatagtatatattttgtacactttgttacacagacacacaaatgcac
ctatttataccgggcaagaacacaaccatgtgattatctcaaccaaggaactgag
gaatccagcacgcaaggacatcggaggtgggctagcactgaaactgcttttcaa
gcatcatgctgctattcctgcaaatactgaagaagcatgggatttaaa
tattttacttctaaataaatgaattactcaatctcctatgaccatctatacat
actccaccttcaaaaagtacatcaatattatatcattaaggaaatagtaac
cttctcttctccaatatgcatgacattttttggacaatgcaattgtggcactggcac
ttatttcagtgaagaaaaactttgtggttctatggcattcatcatttgacaaatgcaa
gcatcttccttatcaatcagctcctattgaacttactagcactgactgtg
gaatccttaagggcccattacatttctgaagaagaaagctaagatg

*Homo sapiens* MIS18 binding protein 1 (MIS18BP1):

(Seq ID No: 806)

ggccctctctccgcgcggagccgagccggaactgcggcag
tctctcccctgccaggctcttcatccaaggtttctgtggatcccttctgaagttc
tatctgaaaattgcgcttaagtgaattttctgttagaagaacttggttgctactttctt
gtcaagatg

*Homo sapiens* LMBR1 domain containing 1 (LMBRD1):

(Seq ID No: 807)

ccgcccctttaacctttagggtgcgcgggtgcagtatatctcgcgctctctccccttttcc
ccctccccttttcccaccccgggcgctcaggttggtctggaccggaagcgaagatg

*Homo sapiens* ST6 (alpha-N-acetyl-neuraminyl-2,3-beta-galactosyl-1,3)-N-acetylgalactosaminide alpha-2,6-sialyltransferase 1 (ST6GALNAC1):

(Seq ID No: 808)

cttcctctagaacccgacccaccaccatg

*Homo sapiens* spermatogenesis associated 7 (SPATA7):

(Seq ID No: 809)

gctcctcttttccagtcctccactgccggggctgggccggccgcgggaaggac
cgaaggggatacagcgtgtccctgcggcggctgcaagaggactaagcatg -continued

*Homo sapiens* docking protein 5 (DOK5):

(Seq ID No: 810)
cctcctccttcctcctcctcctcctccttcttctcctccttctcggccgggag
gaggcagggctggatccctcagccgccgccgctcctcctcctggcaggccggccgcg
gagtcagctgac
gccggcgctccagcctcgcctccccgcgccgcgctctgcgctccccgaaagtggctg
caagccggccgcccactgtcagggttgggggacaga
gaaagtgatgtgcgccttctaaagcctcgcccagcgccgccgaagcagcttcac
ctctccaactttctcccaccgactgcttgtctt
gaccctgccctccaccctcccagagccacttcgggtgcgcgctcttggg
taaaggggggtcaccggctgtctgggatg

*Homo sapiens* glycosyltransferase 8 domain containing 1 (GLT8D1):

(Seq ID No: 811)
tctcctccatcgcctgcagtaagggcggccgcggcgagcctttgaggg
gaacgacttgtcggagccctaaccaggggtatctctgagcctggtgggatcccg
gagcgtcacatcactttccgatcacttcaaagtggttaaaaactaatattta
tatgacagaagaaaaagatg

*Homo sapiens* cullin-associated and neddylation-dissociated 1 (CAND1):

(Seq ID No: 812)
tggccttttgccctagggagcgagtgcggagcgagtgggagcgagac
ggccctgagtggaagtgtctggctccccgtagaggcccttctgtac
gccccgccgcccatgagctcgttctcacgcgaacagcgccgtcgttaggctggctctg
tagcctcggcttaccccgggacaggcccacgcctcgccagggaggggg
cagcccgtcgaggcgcctcccctagtcagcgtcggcgtcgcgctgcgaccctggaagcgg
gagccgccgcgagcgagaggaggagctccagtggcggcggcggcggcggcagcgg
cagcgggcagcagctccagcagcgccagcaggcgggatcgaggccgtcaacatg

*Homo sapiens* BRICK1, SCAR/WAVE actin-nucleating complex subunit (BRK1):

(Seq ID No: 813)
cgctcttcctcaggcggcggccatg

*Homo sapiens* zinc finger CCCH-type containing 15 (ZC3H15):

(Seq ID No: 814)
cggtcttcctcctcgtcctgccgcagggccagaacccctgacggtattcagctgcgcg
taagtctggccggtgccatctgtctccgcaatg

*Homo sapiens* polo-like kinase 1 substrate 1 (PLK1S1):

(Seq ID No: 815)
cggtctccttcggcaaccccggccgaacggccacccagaggctgtgctgagctggcgcag
cggcagcagcatg

*Homo sapiens* dysbindin (dystro-brevin binding protein 1) domain containing 2 (DBNDD2):

(Seq ID No: 816)
gtttctttcctacgcagccgctcctgccgccgtggtcgctggagcttt
gcctctctaggccggcagcgcctctcctccatggtcctgtctgtcagcgctgttttgg
gagcccgccggtgaggccgggccacgctcagacacttcgatcgtcgagtctgtcac
tgggcatg

*Homo sapiens* KIAA1704 (KIAA1704):

(Seq ID No: 817)
gattcttttggatagggttgac
gttcgtggatagactcatatctgtgaccagtgtccgccaccgcggatg

*Homo sapiens* solute carrier family 25, member 37 (SLC25A37):

(Seq ID No: 818)
ccccctccctgcccacctcctgcagcctcctgcgccccgcgagctggcggatg

*Homo sapiens* myoneurin (MYNN):

(Seq ID No: 819)
cgtcctcccaagatggcggagacagag
tgaagaaactgtgttccccccttgggttgctatcgatcaagggtaaaattccattctga
tatcaaaatg

*Homo sapiens* vacuolar protein sorting 33 homolog B (yeast) (VPS33B):

(Seq ID No: 820)
gcttctttttctggtagaaggcggggttctcctcgtacgctgcggag
tctctgcggggtgtagaccggaatcctgctgacgggcagagtg
gatcagggagggaggtcgagacacggtggctgcaggtctgaga
caaggctgctccgaggtagtagctctcttgcctggaggtggccattcattcctggag
tgctgctgaggagcgagggccatctggggtctctg
gaagtcggtgcccaggcctgaaggatagccccccctt -continued
gcgcttccctgggctgcggccggccttctcagaac
gaagggcgtccttccaccccgcggcgcaggtgaccgctgccatg

*Homo sapiens* zinc finger, C4H2 domain containing (ZC4H2):
(Seq ID No: 821)
aggcctctccaagcccctaccgcacaggctcatagcccaagcccggaggaggtggc
tacattgtgtctattgtatccctggctggtgtatttgtacatctctcgggac
gtgaaattgacagtgaaaagtatg

*Homo sapiens* BAI1-associated protein 2-like 1 (BAIAP2L1):
(Seq ID No: 822)
cttcctctggcggcgtccggccgcttctcctctgctcctcgaa
gaaggccagggcggcgctgccgcaagttttgacattttcgcagcggagacgcgcgcggg
cactctcgggccgacggctgcggcggcggccaccctccagagcccctag
tcgcgccccggccctcccgctgcccggagtccggcggccac
gaggcccagccgcgtcctcccgcgcttgctcgcccggcggccgcagccatg

*Homo sapiens* solute carrier family 25, member 40 (SLC25A40):
(Seq ID No: 823)
cgtcctctctcgcgcctcgctctggccctgcaggttgtgtttccgcctctaccccgcctcc
attccgttgctctctcagtctcagacccgggctctcggtccgccgcttcaggtcttggcg
cagcctcagagagttggcgcggctctgtgttgaccaaaacctagtggatgcagttagcgcc
ggagcccggccccgccgtcaccaggggttattcccgccttctaggtttgccaggactgcc
ggccctgcagctgccttctgccccaggttttttggctactgatgttacaaacaataaaata
ttggagcatagagttgaagaacagactcaaaccaggttttttatttaattagt
taaaaatatg

*Homo sapiens* protocadherin alpha subfamily C, 2 (PCDHAC2):
(Seq ID No: 824)
tttccttttccctccccctggagctgtagcggcagcagcagcaggaa
gccgagccgggttgagcgactcggaggcgagcggaggagctggaatatggggag
tcagcgaggacggtggggccaggagcccttgggagggcctac
ggagggagcggccccaggcgctttctagagcgtgagcggtggggagcaggcg
cagggtggcacgagcggaggcgggccgggcgtggggcacggctggggaa
gctgccgcctccggccctgccggctgcctccgccgcggccagtggctatg

*Homo sapiens* chondroitin polymerizing factor 2 (CHPF2):
(Seq ID No: 825)
gttccttttgtgggttagctttggcagtattgagttttacttcctcctcttttttagtg
gaagacagaccataatcccagtgtgagtgaaattgattgtttcatttattaccgttttt
ggctgggggttagttccgacaccttcacagttgaagagcaggcagaaggagtt
gtgaagacaggacaatcttcttggggatgctggtcctggaa
gccagcgggcctcgctctgtctttggcctcatt
gaccccaggttctctggttaaaactgaaagcc
tactactggcctggtgcccatcaatccattgatccttgaggctgtgcccctgggg
cacccacctggcagggcctaccaccatg

*Homo sapiens* thioredoxin-related transmembrane protein 3 (TMX3):
(Seq ID No: 826)
gcttctcttccgctccgggtcggctccgtttccctttccgggcggg
caggcggcggacccagtgtctttatccctcttttgcacagtcagcttctg
cagctctcccgggctagcatg

*Homo sapiens* ras homolog family member F (in filopodia) (RHOF):
(Seq ID No: 827)
cgacctcttggctccgctagtgcccggcgcgccgccgccagtgctgcgggc
tccgggcaatg

*Homo sapiens* amyloid beta
(A4) precursor protein-binding, family B, member 1 interacting
protein (APBB1IP):
(Seq ID No: 828)
ctttctctcaggaaactccactcccaactgacaggtgctatttccagccagtcctatgct
gttgcaaatagtgagtccatgaatgccctctgccgtgtgcattacttattttcatcagca
gatcttcgtaacacactcctggaagtgggatgacggggtcaaaaggcgaatccatacata
agttaaatagatattgctcaattctcttccacgggggttcagaccattttggatttctacg
agcaatgaagacagtgctattcctctacaccctggccggccaactgagcgtggttaaacg
tggggagggaggagggtgaggttaccaacctgatggttgagaaagggcctccgcccagcg
cgcccttcctccaccccacccgagagacagctgaactccggccgggacgcgcgtgttgc
cagtccagccctgcaccgcgtccctgagggcgggctgcaggcggccgggaagccttgca
caaccggcccaaaagaggaagcccagaaagtgctgaagtaaacactttgggagaccgttg
caacataaagcggcctctcagtctttggtggaaccatcactaggccccaatccttagtc
cctcttgcgtcgaggctgcaaaatggttccattcgccaggagacgcctcctgagagaaggg
cgcgcgcggcacaggggccttccttgcacctcggagcaaagcagctcggatagcgccaca
cgtctgcgcgctgcgtgggaagggcagggctgacagcacttcctccccggggcagcgacc
tggagcccgggtgcggcagtctgcaccgcgcgtcgctttccggccggagtctcgccgcc
ttcccgcgcccccgcagcgccccgcagagcagtcgagatg

*Homo sapiens* roundabout, axon guidance receptor, homolog 4 (*Drosophila*) (ROBO4):

(Seq ID No: 829)
ccttccctcttcactgtgagctcagagcagcag
gacaaagtgctcgggacaaggacatagggctgagagtagccatg

*Homo sapiens* translocase of outer mitochondrial membrane 7 homolog (yeast) (TOMM7):

(Seq ID No: 830)
acctcctttcccttteggattcccgacgctgtggtt
gctgtaaggggtcctccctgcgccacacggccgtcgccatg

*Homo sapiens* major histocompatibility complex, class II, DR alpha (HLA-DRA):

(Seq ID No: 831)
ttttcttttattcttgtctgttctgcctcactcccgagctc
tactgactcccaacagagcgcccaagaagaaaatg

*Homo sapiens* protein arginine methyltransferase 8 (PRMT8):

(Seq ID No: 832)
cctcctctactatctcggtatcaccaaaccttgccggctcttatg

*Homo sapiens* adducin 3 (gamma) (ADD3):

(Seq ID No: 833)
ctgcctcttatgaagcaa
tactagagaggaaaaacaaaacccattcctttaagaaagattccgcctcctctcataa
gcaagcgcctaatggtaattgtagagtttactaagtcaaacacttactactcagcatt
gagagaa
gctgctgctgctaatgctgctgctgctgctgccgccgccgccgctgctgctgctgctgtt
ggtctgaggctgcagtaggtttctgtgcagcattgcagaatccacacctaga
gaacagaagacacagacacgtacgtctactacccttgttagaaggaagcttt
ggatcttcggtggataacaagagtaatccacagacttaaaacatg

*Homo sapiens* BarH-like homeobox 1 (BARHL1):

(Seq ID No: 834)
agcccttt
ggatctaatgcgcagaggaggtt
ggcccagagctcccgggctcccccaaggctgaactccgtccaaggtgcccg
caggctccctgcccgccttccccatgccagcccgcagctaggggcaggggg
cagcggcggctgggggttgggggtgggtgggagcttttggggaggacaggtcgcagctt
ggctatg

*Homo sapiens* intraflagellar transport 46 homolog (*Chlamydomonas*) (IFT46):

(Seq ID No: 835)
ttatctttttgcctagcgactgacaacaggctggttgctt
ggcgtggaatcctaaagtggcctggctttgagactggagtga
gaccccagcccctaggctggggttcttccattatagaggagacggattcagaagggc
tacagaccaaggttgttgaaaaccagacatatgatgagcgtctagagattaac
gactccgaagaggttgcaagtatttatactccaaccccaagacac
caaggacttcctcgttctgcccatcttcctaacaaggctatg

*Homo sapiens* carbonic anhydrase X (CA10):

(Seq ID No: 836)
ccccttttcgggag
gagggaggcagggacttgcaggcaagagttgcacctggtctaggaacctgcagagaaaa
gaactctggggtaagtagtgttctggcactggcacggaaagggtaaagggtgggggg
catgagagggacgaaatggagagggcagggaatgaattatgcaaaaaaatctccaa
tatttcgcagcggagggagagcacagcacagcactcccaggatgag
tcctgcctgggtctcccgcgccgaacccgcagcacgaagttcttttttaagaaga
gaaactcgaaaatcctggagggtaacagaggcagccagggcggggcggagtgcg
gaggcggctgccagggactggggccgaggcggcggccaaggtggcctgaa
gctgtgacacccagcctcctcctcctcctcctcatgccgcgctcagcctcac
ctccccgcccgggcctcctgcctccgccccgggtgccgggctgcggagctgacgctgg
gacgcccggcggcggcgaggacgctcacctggccaa
gcctccttctcctcctcccctcccgcccccacctgtcctcctcctctctgagttgg
gaagcgtagggatccgtaggcgaggaaataacgacccctgcagttgtattgcg
gaaaatctcgacagcggcgctagttgcgggcgatggaa
gccaggcaactgggggttctggggagttcaggaaaatagcagaggagcag
gaagggcgcgcgcgacctggagagtctgtgtgccccaccgcgcccag
tccccggggcccagcccttcccctcggcgccctgaacgcactgccggaacccggctga
gaggctgcaggctgcgcgcggacctggggagcagggagggtcggcg
gaggctgccggcggctggcggtttcgggcaa
taatccctgcctctctttctctgtgtgtctgctgtgtctgctccttccccgcccccg
gaagcaggaaagaactgccccggagcgcagcagccaccctccgac
catgccccggtgagggggcggacttcgagggcaacttgccgcg
gactgcctgggcttagccagcgagctacgcgctcccgggagcccggaattgcacggcg
cagcccggcgggggctatcgtctatgtcttcttggggcgccagac -continued

```
gaatcggggtctcgttttttgctggaagagcccagtgtt
ggtggcttcaggtggctgctgccgccgccgccgccgccgctgctag
tgcggtttccgccgctggtgcgaagagaagagacacgcgagcggggagac
ctccaaggcagcgaggcatcggacatgtgtcagcacatctggggcg
cacatccgtcgagcccgaggggagatttgccggaacaattcaaactgcga
tattgatcttgggggtgactgtccctggccggctgtcgggtgggagtgcgagtgtgcac
tcgctcggaagtgtgtgcgagtgtg
tatgtgtgtgtgccgtcgggctccccccttcccccgttttcccgtcgag
tgatgcacttggaatgagaatcagaggatg
```

*Homo sapiens* dual specificity phosphatase 22 (DUSP22):

(Seq ID No: 837)
```
cctcctccctgtaacatgccatagtgcgcctgcgaccacac
ggccggggcgctagcgttcgccttcagccaccatg
```

*Homo sapiens* olfactomedin-like 3 (OLFML3):

(Seq ID No: 838)
```
gttccttctactctgg
caccactctccaggctgccatg
```

*Homo sapiens* phosphoribosyl transferase domain containing 1 (PRTFDC1):

(Seq ID No: 839)
```
ccgtcttcccttcccgcgttccccgggagaaacatg
```

*Homo sapiens* translocase of outer mitochondrial membrane 22 homolog (yeast) (TOMM22):

(Seq ID No: 840)
```
cctcctttccgcttccggtgtcccta
cagtcatg
```

*Homo sapiens* arrestin, beta 1 (ARRB1):

(Seq ID No: 841)
```
gctcctcctgctggctggg
gattttccagcctgggcgctgacgccgcggacctccctgcgaccgtcgcggaccatg
```

*Homo sapiens* cytokine induced apoptosis inhibitor 1 (CIAPIN1):

(Seq ID No: 842)
```
cctcctctcgcgagaggcgcaaggcgtggagtcgacggctggagagaa
gccgggagcgagcccaggcggcagtcttgattccctttttggccagcag
tttttaggtctgtcagtactgcactgcaagaatg
```

*Homo sapiens* leucine zipper transcription factor-like 1 (LZTFL1):

(Seq ID No: 843)
```
taccctccttccccatttctgtggtccaac
taccctcggcgatcccaggcttggcggggcac
cgcctggcctctcccgttcctttaggctgccgccgctgcctgccgccatg
```

*Homo sapiens* phospholipid scramblase 4 (PLSCR4):

(Seq ID No: 844)
```
agccctcccttccgcgcgcttactttgtttataactt
gaaaaatcctctccgtctcccttccctgcctccttttccttcccttcctctgccag
tacaactagacccggcgtctggcgtcccggtgcccagcattctgcggggcaggcggat
taattggaattcttcaaaatg
```

*Homo sapiens* ectonucleoside triphosphate diphosphohydrolase 7 (ENTPD7):

(Seq ID No: 845)
```
cctccttccggctgggcaaggggccgcggggagcagctcgggactgaac
cgagaggtgccgaaggaaccggcgggccgcttgatcccgctgcagacgtagga
gatgcctgggacaaggaggccaccttctcagggcaaaagaaaaa
gaaggtgacaggcgttgagaccaccgaagggaacccatg
```

*Homo sapiens* fascin homolog 3, actin-bundling protein, testicular (*Strongylocentrotus purpuratus*) (FSCN3):

(Seq ID No: 846)
```
agttctctctgg
gaacatctggtgggtactacaggcccctattccaggccctatggcctgtggaacctcac
cacggggggagggctgggccagacggagacatcacctgtggtgtcagcccatg
```

*Homo sapiens* X-prolyl aminopeptidase (aminopeptidase P) 1, soluble (XPNPEP1):

(Seq ID No: 847)
```
cctccttcgcgccggcccttccgcgggtgatcagctggtctgcgctcccctgac
gtgggctggggcacgtcaccgccgaatg
```

-continued

*Homo sapiens* REX4, RNA exonuclease 4 homolog (*S. cerevisiae*) (REXO4):

(Seq ID No: 848)
gggtctcttccggagtcttttcctggac
ggggtccctgcggtgggtgtgtttcggcctggcctgggcaggcgctt
gtgctgccagggcgccgggcccggg
gaggccggggtctcgggtggccgccggcccaggcgctggacggcagcaggatg

*Homo sapiens* LYR motif containing 4 (LYRM4):

(Seq ID No: 849)
ttttctttccaaaatg

*Homo sapiens* DEAD (Asp-Glu-Ala-Asp) box polypeptide 24 (DDX24):

(Seq ID No: 850)
ggttcttcactcgcgactgacggagctgcggtggcgtctccacacgcaac
catg

*Homo sapiens* transmembrane protein 159 (TMEM159):

(Seq ID No: 851)
ccttcttcctcttgttcctcctcctgcctctcttcgcttcgcctgcaaac
gcggtggggctgctcggcggtcaggagcaggttaccctccgtctgcatgcccac
catcaaggtatgaggatggtagaagctctcgtcgaaccagatggatgaagaccactaac
ggcttttgtttcctctggtaacagcaagagacagagcgacatgagagattggac
cgcgggctgcactgagaatttactggtaggataattcatccctaaaga
gattgaagtgagcttcagaatg

*Homo sapiens* NDRG family member 4 (NDRG4):

(Seq ID No: 852)
cggcctccgcccctg
cagccgcgggcacgcggagggctcctggctgcccgcacctg
caccgcgcgtcggcggcgccgaagcccgctccccgcctgcgcgtctgtctcgtccg
catctccgcggcctcctgctccacgacgtgaccatg

*Homo sapiens* pre-B-cell leukemia homeobox interacting protein 1 (PBXIP1):

(Seq ID No: 853)
ttttcttctcgggctgcaaacaaagggaagcctgcaacaagttaa
gctgaagaccgaagcaagagctggttcaggtggcagccacagcagcctcagggac
ctcagcaactatg

*Homo sapiens* twisted gastrulation homolog 1 (*Drosophila*) (TWSG1):

(Seq ID No: 854)
ctgtctctttaaggtgcccgaggctcgcgggcgctgcgctgaggggac
ggcgggaggcgcggcctggcctcgcactcaaagccgccg
cagcgcgccccgggctcggccgacccggcggggatctaggggtgggcgacttcgcgg
gaccgtggcgcatgtttcctgggagttactgatcatcttctttgaagaaacatg

*Homo sapiens* zinc finger protein 286A (ZNF286A):

(Seq ID No: 855)
gtcccctttt
gtgaggcccgggatgggaggtgcccggttcccccagggacagcttcaagcgg
tagggacagacatctgag
gacccagcctcagggatgctgtccccgggcttccaggctccagcgccgtag
gactgaggcagactccacggtgagaaaga
gacccgatctaacccaggccttcatcagagcccaggagggaaggcaggaagtgggac
cacgaggcccggggggcttctaactcgtctggccagggagatctgaattgggtgaa
gagcagaatctccagaacaaggaggaggtggtgatcatg

*Homo sapiens* S100 calcium binding protein A14 (S100A14):

(Seq ID No: 856)
gctcctcctgtctt
gtctcagcggctgccaacagatcatgagccatcagctcctctggggccagc
tataggacaacagaactctcaccaaaggaccagacacagtgggcaccatg

*Homo sapiens* ANKHD1-EIF4EBP3 readthrough (ANKHD1-EIF4EBP3):

(Seq ID No: 857)
tgctcttctcgttcccgagatcagcggcggcggtgaccgcgagtgggtcggcac
cgtctccggctccgggtgcgaacaatg

*Homo sapiens* KIAA1143 (KIAA1143):

(Seq ID No: 858)
ctgtctttacccagagctaccatg

*Homo sapiens* neuroligin 4, X-linked (NLGN4X):

(Seq ID No: 859)
ctctcttttctt
gcagaaccgtctctctcccttctctgtctcttagcacagagctcttattcagccac -continued tagcttggcccttcctgcttcaattgtaatgcttgttctgcccgtccacagac
tattggcggcagaaacaacgaatttcctccaaactaggcggtgttggtggctctt
gcattcctctggatgaggaaatctagttgggggttccagaaggg
gaaggctcctgggctttcaatacatcctcctgaatcatacctcgtttcgggttcccta
gaaaaatctggacgtgtaaaaagaactcttaacggccgatgcagctcttccaaa
gctaaggctgccttggagttttcataagaaattgtccctggaggtgtt
ggatgatcacagcttccttggagcattgcagttgctggaatccagtttcaggat
taagggagggctgcctccttgcaatgggctgccaagaaaacggctgtgctt
gttcttaacctcaggctctgtctgtgatcagtctgagagtctctcccaggtc
tactgctccctggaaagccctatctctctgcaggctcgcctctgggctttgtctcctt
ggagccacatcactgggacagctgtggatgtggatgcagatttgaaccatg

*Homo sapiens* mitochondrial antiviral signaling protein (MAVS):

(Seq ID No: 860)

ccgcctcctcgctgcgg
gaagggtcctgggccccgggcggcggtcgccaggtctcagggccggggtacccgag
tctcgtttcctctcag
tccatccacccttcatggggcagagccctctctccagaatctgagcagcaatg

*Homo sapiens* serine incorporator 1 (SERINC1):

(Seq ID No: 861)

ctgtctccatctt
gtctgtatccgctgctcttgtgacgttgtggagatg

*Homo sapiens* KIAA1324 (KIAA1324):

(Seq ID No: 862)

cctccccttttttttccgccttctgccagcagaagcagcagccgcagcacctgagccgc
tactgccgctcactcaggacaacgctatg

*Homo sapiens* synaptotagmin IV (SYT4):

(Seq ID No: 863)

ggacctccctcttt
gcctcctccctgttccaggagctggtgccctgggctctgcgctgtt
gttttcagcgctccgaaagccggcgcttgagatccaggcaagtgaatccagccaggcag
ttttcccttcagcacctcggacagaacacgcagtaaaaaatg

*Homo sapiens* pyruvate dehyrogenase phosphatase catalytic subunit 2 (PDP2):

(Seq ID No: 864)

cttccttctggagctgggtcctgactagggac
cgcctgggtgaggtgaggacctggtggccgcagttgtggcactgtgcg
caggcgctgaactgaccggacggagcgggcggctgtggcctcgccagctggtttaaaaa
tatccttttttgctgaaggaacacatttgctggtatagtttcagaatg

*Homo sapiens* gephyrin (GPHN):

(Seq ID No: 865)

ctatcctttcctctcagtcctgccatctagctgccttgggtctcgcgctccgcagagcgt
tccgacactctccggcctcgttctgccgcctccgcgcgctctccccgtgcggccaccgcg
cccccaagcttgcctcctttcttgccggacttggggccgcgcgccctgactccttcccct
cccgcggacccgcgcactcccggcgcggcctctccccccacgcaggccaccgtgcactctg
tggcctccccctccttcccccgctctcctcgcgcttctctggctcccctagctgtcgcgctc
tcctcggcgagcgcgctcccggcccgcgcgctccgggctccggtttctcccggctcctgt
cagtgcggtgactgcgctgggaaacatg

*Homo sapiens* deltex homolog 2 (Drosophila) (DTX2):

(Seq ID No: 866)

ccttctcctgagagtcggagccacagccagagccctgcccaggccgagccggagctg
cagcccgagcgcggtggtgccctcagcccgtcctctt
gtcctcctcagcctcggtgccttggaatttgtgtcgctgagtcagcaagcctttcagat
ttgcccggtttttgttgtttgtggtttgtatcaagatgg
gaactcaaacaagtcattcctcctaaggagctggtgtcttcatccagaagggacagttt
gtgccagctctccagagagaaaaggatctggtactgttctggagtggcctgtagcaga
cactgaaccaccagccagctgcatttgttgtcctggaagtcattgccaactctgccag
tcacactggggtccccagagaagtcaagatctgccggaggcgctgggcaatgaccccgg
gactccaggccagaggggtctgaagctgtttgggaaagcagcgggactccttgggaa
gatg

*Homo sapiens* melanoma antigen family E, 1 (MAGEE1):

(Seq ID No: 867)

ctgccttttttcaccacctctaatttcagcttcagcagttgcttggaactttggttctgg
cagcagcagcaacatcattaccgctagcggcagttttgtgccgaggcacctacacac
ctcccgtcctctctgccagatcgcgggcctgtcggtgtctgctcctacacgccaac
gccggtgggcaggaccatg

*Homo sapiens* G protein-coupled receptor 107 (GPR107):

(Seq ID No: 868)

cgcccttcaccccggacgtgggcgggagaggaagcggctggtgatgctg
gaacaaacatg

*Homo sapiens* PDZ and LIM domain 1 (PDLIM1):

(Seq ID No: 869)

cgctctttctccgacagctgccggggtgccctgcaa
gctgttccgcgcgtcctgcccgtctgtccccgcgggtcgtcgcccgccacagccgcgc
catg

*Homo sapiens* thymosin beta 10 (TMSB10):

(Seq ID No: 870)

cgctcttttgtttctt
gctgcagcaacgcgagtgggagcaccaggatctcgggctcggaacgagactgcac
ggattgttttaagaaaatg

*Homo sapiens* phospholipid scramblase 1 (PLSCR1):

(Seq ID No: 871)

agaccctttcagacccttttccggctgacttctgagaaggttgcgcag
cagctgtgcccggcagtctagaggcgcagaagaggaa
gccatcgcctggcccggctctctggaccttgtctcgctcgggagcggaaacagcgg
cagccagagaactgttttaatcatg

*Homo sapiens* eukaryotic translation elongation factor 1 beta 2 (EEF1B2):

(Seq ID No: 872)

gggtcctttttcctctcttcagcgtggggcgcccacaatttt
gcgcgctctctttctgctgctccccagctctcggatacagccgacaccatg

*Homo sapiens* pyrophosphatase (inorganic) 1 (PPA1):

(Seq ID No: 873)

ggctctctccttgtcagtcggcgccgcgtgcgggctggtggctctgtggcagcggcggcg
gcaggactccggcactatg

*Homo sapiens* X-ray repair complementing defective repair in Chinese hamster cells 5 (double-strand-break rejoining) (XRCC5):

(Seq ID No: 874)

ggctctttccgctatctgccgcttgtccaccggaagcgagttgcgacac
ggcaggttcccgcccggaagaagcgaccaaagcgcctgaggaccggcaacatg

*Homo sapiens* GATA zinc finger domain containing 1 (GATAD1):

(Seq ID No: 875)

gatccctttcccagtcctgcttcccag
tgcctcgggccagggaatcctggcctccgcctgcggagccggc
gaacccgcttcccgcctccacggggcagcgccagcggcctggtccttttcaccgg
cagctccgtgccgacgctctcaccgctcttcctatcgccgggagtggcgggccgac
caggggcggccgggctac
cgtccgccattcccgtgtctctgcgcccgcgggggccgcccgagccggccaccatg

*Homo sapiens* enolase-phosphatase 1 (ENOPH1):

(Seq ID No: 876)

ccgccttttccag
ttccaggtgtgcagaagtgtcctctccccacgcgcggcgggctgcactt
ggtcgctggctccgagatcgcgcggggccgccggaagcccaagacggtaccgggggccg
cagccgcagccggcgccgccctccgccctccccaacagcaggccgagtcccgtag
catccggtagggaaatg

*Homo sapiens* regulation of nuclear pre-mRNA domain containing 1B (RPRD1B):

(Seq ID No: 877)

agctctttccgggggcccggggaactactctcctt
gcctcgctctgtctccttcgaagtgctctgcgcgaggttcagagcggccgccgcctccaa
agggacggttttctagagctccgacgcctctcggtgcccctctgctccggcccttt
gcccttttgacctcgctctcgcggcagggtgagaggtcgggtggccatctt
gtggcggcggcgggcggctgttactgcggagacccatcccctcccccttctcg
caccccctggcagtctgtcagtcggtaaaaagtcccg
cagcctgtcaggtgaggcccccggcctcgtgccgtcgctcttcccgccgcac
tgggcggcccaggccgctccctgccgggcctcactgccgccaccatg

*Homo sapiens* family with sequence similarity 60, member A (FAM60A):

(Seq ID No: 878)

ctatctttctagacaaggcagttgaggaggagggagcgcttgaggggg
gactggcctggcgtgcactccgcacctcggggacattattgcgcgtggaac
ggctgcttttggaaggcacaacttcctgaatggaccatgactcccaccaaa
gatccctgtctctgattcaccaaacagcttcaaccctgaaaccaggacgagaagtt
gacaacatctgagtggacagctaattgacctaagacttcagaccagac
tattgcccagaagaaaagatg -continued

*Homo sapiens* MID1 interacting protein 1 (MID1IP1):

(Seq ID No: 879)

gggccttttatctcggtgctgccgggggaggcgggaggaggagacaccaggggtggccct
gagcgccggcgacacctttcctggactataaattgagcacctgggatgggtaggggccca
acgcagtcaccgccgtccgcagtcacagtccagccactgaccgcagcagcgcccttgcgt
agcagccgcttgcagcgagaacactgaattgccaacgagcaggagagtctcaaggcgcaa
gaggaggccagggctcgacccacagagcaccctcagccatcgcgagtttccgggcgccaa
agccaggagaagccgcccatcccgcagggccggtctgccagcgagacgagagttggcgag
ggcggaggagtgccgggaatccgccacaccggctatagccaggccccccagcgcgggcct
tggagagcgcgtgaaggcgggcatccccttgacccggccgaccatccccgtgccctgcg
tccctgcgctccaacgtccgcgcggccaccatg

*Homo sapiens* transmembrane protein 35 (TMEM35):

(Seq ID No: 880)

ctctcccttt
gtcattctagctgcctgctgcctccg
cagcgtcccccagctctccctgtgctaactgcctgcaccttggacagagcgggtgcg
caaatcagaaggattagttgggacctgccttggcgaccccatg

*Homo sapiens* Fc fragment of IgG, low affinity IIa, receptor
(CD32) (FCGR2A):

(Seq ID No: 881)

cttcctcttttctaagcttgtctcttaaaacccactggacg
ttggcacagtgctgggatg

*Homo sapiens* tribbles homolog 2 (*Drosophila*) (TRIB2):

(Seq ID No: 882)

cttttctcttttgtttggcttctaacgcgttgggactgag
tcgccgccgtgagctccccgaagactgcacaaactac
cgcgggctcctccgccccgtctgcgattcggaagccggcctgggggtcgcgtcgg
gagccctggcgctgcagctccgcaccttagcagcccgggtactcatccagatccac
gccggggacacacacacagagtaactaaaagtgcggcgattctg
cacatcgccgactgctttggggtaacaaaaagacccgagttgcctgccgaccgag
gaccccgggagccgggctcggagcagacgaggtatccggcggcgcccattt
gggggcttctaactctttctccac
gcagcccctcttctgtcccctcccctctcgctcccttttaaaatcagtggcac
cgaggcgcctgcagccgcactcgccagcgactcatctctccagcgggttttttttt
gtttgtcgtgtgcgatcctcacactcatg

*Homo sapiens* family with sequence similarity 3, member A
(FAM3A):

(Seq ID No: 883)

cgtcctctccggggcggagcgggtcggcgggcctgacagggaac
ctccctgaccgagcccacgtctccccacggccagagaaatctccggcccggcccg
catcgccagcccccaggcccggaggaacggcccgagcccaggagaac
cacatcttcgtcccagccccggaggctcctgtgggcaagatcgtgagcaac
gggttcctgaggcccctcctggccaggcagggtttccccgcgcgtttccgag
gagccctgcctggccggggcggctggacaaacaggtcgtagcac
cgatcgcgcccgccccagcaggggtcccgcacaggctt
gcccctgaccccacccaaacctgtccttccgctttgcccccaaacagtgcactt
gccggcggtcccaacccagcaggagaagtggacatg

*Homo sapiens* exocyst complex component 4 (EXOC4):

(Seq ID No: 884)

ggctctccccgcgtccaagatg

*Homo sapiens* ELOVL fatty acid elongase 5 (ELOVL5):

(Seq ID No: 885)

gcgccttcctcttcccatcgcgcgggtcctagccaccggtgtctccttctacatccgcct
ctgcgccggctgccaccgcgctccctccgccgccgccgccttgctgctgctcaaagctg
ctgccgcccttgggctaaaaggttttcaaatg

*Homo sapiens* apolipoprotein B mRNA editing enzyme, catalytic
polypeptide-like 3G (APOBEC3G):

(Seq ID No: 886)

ctttctctttcccttttgcaattgcctt
gggtcctgccgcacagagcggcctgtctttatcagaggtccctctgccagggg
gagggcccagagaaaaccagaaagagggtgagagactgaggaagataaa
gcgtcccagggcctcctacaccagcgcctgagcaggaagcgggagggggccatgactac
gaggccctgggaggtcactttagggagggctgtcctaaaaccagaagcttggag
cagaaagtgaaaccctggtgctccagacaaagatcttagtcggactagccggccaag
gatg

*Homo sapiens* gamma-aminobutyric acid (GABA) B receptor, 1
(GABBR1):

(Seq ID No: 887)

gctcctcctcctcccctccgtcggtcagtcagtccgcgaggagag
tccgcggtggcggcgacggtggcgagagccgcgggggccgtaggaagccaac
cttccctgcttctccggggccctcgccccctcctccccacaaaatcagggatggaggcgc -continued ctccccggcaccctcttagcagccctccccaggaaaagtgtcccccctgagctcctaac
gctccccaacagctaccectgccccccacgccatg

*Homo sapiens* cofilin 2 (muscle) (CFL2):

(Seq ID No: 888)

cctccttctcctcccag
tgccacagagccgaagcccgagctgccgccgcagccacagccgagggcactatg

*Homo sapiens* DEAH (Asp-Glu-Ala-His) box polypeptide 35 (DHX35):

(Seq ID No: 889)

tgacctttaccccaacatg

*Homo sapiens* resistance to inhibitors of cholinesterase 8 homo
log A (*C. elegans*) (RIC8A):

(Seq ID No: 890)

ccgccttccccggcgcgccatg

*Homo sapiens* FK506 binding protein 10, 65 kDa (FKBP10):

(Seq ID No: 891)

ag
ttctttgtagtgcctccctcagactctaacacactcagcctggcccctcctcc
tattgcaaccccctcccccgctcctcccggccaggccagctcag
tcttcccagcccccattccacgtggaccagccagggcgggggtagggaaagaggacag
gaagaggggagccagttctgggaggcggggggaaggaggtt
ggtggcgactccctcgctgccctcactgccggcggtcccaactccaggcaccatg

*Homo sapiens* small ArfGAP 1 (SMAP1):

(Seq ID No: 892)

cctcctcccgttccagctgccgctgccgcttcctgggctgag
tccgcccgcggtcccggcggcgccaggtgcgttcac
tctgcccggctccagccagcgtccgccgccgccg
tagctgcccaggctccccgccccgctgccgagatg

*Homo sapiens* chromosome 14 open reading frame 93 (C14orf93):

(Seq ID No: 893)

cctccttttgcacacacacgaatacaaagagccatacgaccttcggatgccggaaggtc
cttctgaatcccttccctgttccttaggttgcactagtcggggtccatgctgggggc
agaaggaatgctctctaccgtctgaaaccgttcatcaggaaggccttgatttgtgatgtg
ctaggagagcacaggatctgcaaatagaaggcacctgtctcccttctgcaggccgaggag
aggccgccatggactgtgtgcttcttcatggcttgtttactcttcttcacagaccctac
agcttggggcctgggctcctctgaccatcctcattgagaaaggaaagtgagtccagaaa
gttgatgcttcctacctgttggagcggcccagcagtgtaagcgtggttgttactgcccca
tccgccatg

*Homo sapiens* brevican (BCAN):

(Seq ID No: 894)

cgccctcttccgaatgtcctgcgggccccagcctctcctcacgctcgcgcag
tctccgccgcagtctcagctgcagctgcaggactgagccgtgcacccggagga
gacccccggaggaggcgacaaacttcgcagtgccgcgacccaaccccagccctggg
tagcctgcagcatg

*Homo sapiens* H2.0-like homeobox (HLX):

(Seq ID No: 895)

cggcctctcttcctcag
tgcgggcggagaagcgaaagcggatcgtcctcggctgccgccgccttctccgg
gactcgcgcgccctccccgcgcgccccacccaccagtccggctggactgcgg
cagccgcgcggctcaccccggcaggatg

*Homo sapiens* v-rel reticuloendotheliosis viral oncogene homolog
A (avian) (RELA):

(Seq ID No: 896)

ccgcctctggcgaatggctcgtctgtagtgcac
gccgcgggccagctgcgaccccggccccgccccgggaccccggccatg

*Homo sapiens* zinc finger protein 277 (ZNF277):

(Seq ID No: 897)

cctccttttcttttctgccgggtaatg

*Homo sapiens* globoside alpha-1,3-N-acetylgalactosaminyltransferase
1 (GBGT1):

(Seq ID No: 898)

cttcctcttttctgtctggcccgcggccccgctgcctgcctgctccaggctccac
ctgcgccgccgatcgcccgggtatcgcggggcccaggccagctgag
tccgttttccgcgccggggtggcgcccctccaaccgtcctaacgccgggccggcag
caaggagtgttcctgggacctcagagaccaggctcagagcctgacatccctgcgaggg
gacagcctcatccgcccaggccagtgggggtctctacaagtgcccaggctcaggtg
cagcccccagcaatg -continued

*Homo sapiens* FXYD domain containing ion transport regulator 6 (FXYD6):

(Seq ID No: 899)

ggtcctcctgggagtctcggaggggaccggctgtgcagacgccatg

*Homo sapiens* nuclear RNA export factor 3 (NXF3):

(Seq ID No: 900)

tcctctc
tatgcttggggaaggaacttcctgtaagcaaggcttgaggcttgctctcgccttcgtcag
cagccctcctcaatcttctccaaactcccgtcccaggccacacagattctcctcaaga
gagccctataaggacattggtaaaatg

*Homo sapiens* chromosome 14 open reading frame 133 (C14orf133):

(Seq ID No: 901)

attcccttccgcccccttctctaagctgcacagcctgaatagaagggctggtccagcggc
ggcggaggctggcgctgtcctgagagggagggctctgtgcggaagagtcagggcgaccct
tgggcgctggagtacgcttgggactggggctgcgagtgagcaccagcgattggttcggaa
gcggacatttggttcagaacgagcatttaactctgccagggatccgctgggctctgacga
ctgcggtagatccatggcttcctggacgttcaccgtagagtcatcctagcttaactctt
gttccctggtctcagttcacaagcctcacctgtatcttcctggctcggaagataattgaa
accaagtctgacttctcaatg

*Homo sapiens* X-prolyl aminopeptidase (aminopeptidase P) 3, putative (XPNPEP3):

(Seq ID No: 902)

ctttctcttcccgacgcgtgag
ttaggccgtaatg

*Homo sapiens* death inducer-obliterator 1 (DIDO1):

(Seq ID No: 903)

ggccctctggcaagatggctgctgcggaggcgttggagcgcggaaatctggaaccgg
gatgcgacgtctacactgagtcggaggcgaaggagcttactccacgg
gaacagcctctagataatctgagttgttgaaaatacgaagcctgttactcgtgaacag
tggctgacaacagtgttgttgtgagcctggctgtctgctt
ggacccagaggtttcgtctgccagggtttttggttgtatttaggat
ttcagggaaaagtgtccaagctttcagtgttggagcaggtatg

*Homo sapiens* PERP, TP53 apoptosis effector (PERP):

(Seq ID No: 904)

cggcctcttcgcttttgtggcggcgcccgcgctcgcaggccac
tctctgctgtcgcccgtcccgcgcgctcctccgacccgctccgctccgctccgctcggcc
ccgcgccgcccgtcaacatg

*Homo sapiens* tubulointerstitial nephritis antigen-like 1 (TINAGL1):

(Seq ID No: 905)

tcctctcttgactttgagcgtccggcggtcgcagagccaggaggcg
gaggcgcgcggggccagcctgggccccagcccacaccttcaccagggcccaggagccac
catg

*Homo sapiens* eukaryotic translation initiation factor 4H (EIF4H):

(Seq ID No: 906)

ggttcctctcggagcggagacggcaaatg

*Homo sapiens* non-SMC condensin I complex, subunit G (NCAPG):

(Seq ID No: 907)

cccctctcgcgggaattatttgaacgttcgagcggtaaa
tactccctggggctgtcatagaagactactcggagagcgctgcctctgggtt
ggcgggctggcaggctgtagccgagcgcgggcaggactcgtcccgg
cagggttccagagccatg

*Homo sapiens* MMS19 nucleotide excision repair homolog (*S. cerevisiae*) (MMS19):

(Seq ID No: 908)

tatccctcccacggtctctagttcgcgttatg

*Homo sapiens* DnaJ (Hsp40) homolog, subfamily C, member 1 (DNAJC1):

(Seq ID No: 909)

ctgcctctacagctgtgtgtaggcctgggggcgagggtcttcggaac
gtagcgctggctgcggcccgcccgcctaccacccgcccgtccgg
cagccggctcccgccgcctccgcgctctgtctggggccagccac
ctggcggccgctccggtgcgcctgcccgcgcttttcac
tgacaggcgctgttccccacagccagcgccgcccgccacgtcccagctctcggccaac
ggagctgcgcggcgggtgacctttccgagcccagcgcgatg

*Homo sapiens* stimulated by retinoic acid gene 6 homolog
(mouse) (STRA6):

(Seq ID No: 910)

ctacccttt catctctgcaactccttcctccctgggcctcccttctggtgtgtctgtggg
tctgtctaggtgggcttgggaaaggggaaggaaggggcgtctctttaggcagctcagact
ggacaagccttcttt
gaaaatggtcctttgaacacacgcctgctggtggttggtcagacagatgcgccagcgg
gagcccggggcccaaggggacagctatctctgcaggaccagtgcgatg

*Homo sapiens* 5-azacytidine induced 2 (AZI2):

(Seq ID No: 911)

cagccccttttccggctgagagctcatccacacttccaatcactttccggag
tgcttcccctccctccggcccgtgctggtcccgacggcgggcctgggtctcgcgcgcg
tattgctgggtaac
gggccttctctcgcgtcggccggcccctcctgcctcggctcgtccctccttccagaac
gtcccgggctcctgccgagtcagaagaaatggactccctccgcgacgtgcccggag
cagctcccttcgctgtggaagcggcggtgtcttcgaagaaaccgaa
gcccgtggtgacccctggcgaccggtttgttttcggtccgtttccaaacac
taaggaatcgaaactcggcggccttgggggcggccctacgtagcctggcttctggttgt
catg

*Homo sapiens* polymerase (RNA) I polypeptide E, 53 kDa
(POLR1E):

(Seq ID No: 912)

acgcctttccggcccg
cagcgcggcctgggctcccgcgtgtttaaaagtgcgctt
gtggctgctgctgtcttaactcctgtgcttggcggacagacaggcgagatg

*Homo sapiens* mitochondrial ribosomal protein S25 (MRPS25):

(Seq ID No: 913)

agtcctttctcgtcgctgctcggctcgcggcccgtggggtcggccccgccaccgtt
gccgccatg

*Homo sapiens* TRM2 tRNA methyltransferase 2 homolog A
(*S. cerevisiae*) (TRMT2A):

(Seq ID No: 914)

cggcctccgccgcacgcgctggcggactaagag
tggctggcgaagcgagcggccggcgcgggcccctggcgggcgggcggtacagcccaa
gcctgagacccggacctgagcatcgcaggttcgagtcccgccccgcctggggcgaa
gccgggggtggcggcgacctcgcggcgttgcaccggctctgtgagcac
ctcccctctgagcacttcccttgtgacaggccacttcccttgtgacaggccaggac
gaggtggccaggcggcccccatggcgtccctggtctaggcggagaaccgcctgggcgatg

*Homo sapiens* lipid phosphate phosphatase-related protein type
2 (LPPR2):

(Seq ID No: 915)

cccctccctccacctcggagtctgcgcggcgcggccaggcccggccgaccgcgtctcggtc
ttcgcgtctgccagcctggctggcagtccgtctgtccatcccgccgcgccggggcagtct
aggcggagcgggggctcaggcggcggcggcctcgacgcgagtgagtgtcgtggttgggt
gctggacccagagtgcctaccctgcctgcctgggcctcagtttccacatctgcacaatg
ggggtgaccatccctgccctgctggctgccaggagcggctgtgagtcttcaggcgtggat
gcagcctggggggaagccatagggcgctttcacaggcctggccttcaccatg

*Homo sapiens* chromosome 11 open reading frame 1 (C11orf1):

(Seq ID No: 916)

gaacctttttcacctcgtctgaaatg

*Homo
sapiens* microtubule associated monoxygenase, calponin and
LIM domain containing 1 (MICAL1):

(Seq ID No: 917)

cgccctcccacccgctcagac
ctggttgccagcccaacaggaagcggcccctcccggcttcggagccgccgccac
tcatctctgcccagctgctgccctccccaggaggcctccatg

*Homo sapiens* kinesin light chain 2 (KLC2):

(Seq ID No: 918)

gctccttttaaggcagcgaacgggccaagagaagcgtgtttcgcccctccgacgccac
cgaggtagcggcttcacctttaaggcggcgcggggctgctgggaaggccggcgg
gatggaggcggcgggaccggctcgcgggtgcgggtccgggtgaagcgg
gaggcagccagagtcggagccgggcccgagcaccaggcg
caggcccggcgcccgcctgcccgcaccctcgtcctcacagacgccacagccatg

*Homo sapiens* DNA cross-link repair 1B (DCLRE1B):

(Seq ID No: 919)

acttcctttttctgcccactctgg
taacttattgctctgctgggctctttcccttagggtctctggccctgttcttgcccag
catgacttttatcgggacgccgttgtggaagcctcacgcaggagccctgcccccgtgga
gaagatcccactggtgactccaaccctaccaccatg

*Homo sapiens* armadillo repeat containing, X-linked 5 (ARMCX5):

(Seq ID No: 920)

gctcctcccactgccgttgtgggtaacgcggacgtggaagaac
ctcgtctgcggaggaaaaggtagatgttaaatggtaactacgcgcgaggttctgag
gagccctgggaacaggaaggagaaaagaataccaaaagtgacaacagtttgccaatcg
cagtctttaatctgataaagcggttatctcgtcttgagtcccaggtgccgag
tcaatcccatacacagccgccgccattgcctcgagtcctt
gtgtctgactgtctgttcctgctgctgtatgacacagcacctcgaggcaaggaaataa
gaaaactgcctctgatccaagcagagaaggtctgcctgtagatctgctgtagggctt
gtcaccattggaagcaaggtcctacttcagtggcagatctggtggccttggag
tggctgaagaccaccaccctccacagggctgggcccatgcacagccatccttccctac
cttgagtgagcttcctctgcatgttttctatatcactggcagagcctgtagtt
ggaaaggggacagagtgactactggactttgtgtgaaaacaccaaccgg
gacaaaacttcagtcaaggctgagacgggtgggggtatataacttgtccttac
gttaaacttggaacatg

*Homo sapiens* chromosome 12 open reading frame 43 (C12orf43):

(Seq ID No: 921)

aatcctttgcggtggttcaagatg

*Homo sapiens* vacuolar protein sorting 33 homolog A
(*S. cerevisiae*) (VPS33A):

(Seq ID No: 922)

ggtcctcccgtaggaaccggcggactcggtt
ggcgttgtggggcaggggtggtggagcaagatg

*Homo sapiens* arginine/serine-rich coiled-coil 2 (RSRC2):

(Seq ID No: 923)

gggcctcctcgcctttgtgccatccgggtctctcgcgcgagcgatttagtctgaggcgaa
gcttcggagcggccggtactgttgaaagcgacaagtggagcgccgctctagcggccggg
actctgaactatggcggctagtgatacagagcgagatggactagccccagaaaagacatc
accagatagagataagaaaaaagagcagtcagaagtatctgtttctcctagagcttcaa
acatcattattcaagatcacgatcaaggtcaagagaaagaaaacgaaagtcagataatga
aggaagaaaacacaggagccggagcagaagcaaagagcgtgcttatgcgcgaagagactg
aactgaagacgctgcagactcagatagcaaaataataagcctacttcatgataagggaag
aagacatgaatccaaagatataaatcctctaagaaacataagtctgaggaacataatgacaa
agaacattcttctgataaaggaagagagcgactaaattcatctgaaaatggtgaggacag
gcacaaacgcaaagaaagaaagtcatcaagaggcagaagtcactcaagatctaggtctcg
tgaaagacgccatcgtagtagaagcagggagcggaagaagtctcgatccaggagtaggga
gcggaagaaatcgagatccagaagcagagagaggaagaaatcgagatccagaagcaggga
aagaaaacggcggatcaggtctcgttcccgctcaagatcaagacacaggcataggactag
aagcaggagtaggacaaggagtaggagtcgagatagaaagaagagaattgaaaagccgag
aagatttagcagaagtttaagccggactccaagtccacctcccttcagaggcagaaacac
agcaatg

*Homo sapiens* integrator complex subunit 3 (INTS3):

(Seq ID No: 924)

ccgccttcccacccccgcccttccactatggccgcttctgtgtggtgtggggagac
gctggtcctcccgtcctcccatagcgcttattgcctcaccctcacccctaggggccg
gatccaaaggcgctgcactccccaagccttggggcatcagccaggaaggtttcctac
ctcctaattcaggggcaggactcctcttttccccccacggggaaaa
gaggcagaaacttaggggtttccctcctttcttagggtcagacgctcttagggtccac
ttcttcaggggcggaagcctctcctacccttcccatagggggcacaggcctttaccccac
tgtacttcggagccaacgcctttccctcagcactgccaccccagagtcaggacccagag
gactgtgccttcgccccaacgcaggcgcggcctttttggagaggaggggaggagtgga
gaggacaggggcccttgctctccctcccaaacttgttcctcttgcccccccag
tccctggcaatccagagatcccgatatctaggactgtccatccatccactccctgac
cttttcccggctcctggctgcagccatg

*Homo sapiens* spermatogenesis associated, serine-rich 2 (SPATS2):

(Seq ID No: 925)

tctcctttcctcttctcagacccgggagcgtccgggacgcggagcccg
gagctggggcgacgaggcgattgcggggcctgggctagctgctggctaccaatattc
tactttctgtctctatgaatgtgactaccctggttacctcatataatctccctg
gaaaaggagacatgaatgtctgcaatgatacttcctgacaagaagttgatacaa
gaaaaggaaggagattaacagctagtgagcagaatttcgaacagcaaggatttcg
tatttttttgcttccaactgcacacttccgttgcccactttaaatcagagatac
ctacactcaaaacccagacaaggcaaaaggatactttttcttgtatatttttga
gatcgaagaaacgacaatg

*Homo sapiens* fibroblast growth factor receptor 1 (FGFR1):

(Seq ID No: 926)

ccgccccttcacctcctggctccctcccgggcgatccgcgcccctt
gggtctcccctcccttccctccgtccgcgtcctgcgcccctccctgcgctcgtcccg
ccgctcttcccgccgccgcccaacttttcctccaactcgcgctcgg
gagctggcgaggcggcggcggctcctcaggtcagtttgaaaaggaggatcgagctcac
tgtggagtatccatggagatgtggagccttgtcaccaacctctaactgcagaactgg
gatg -continued

*Homo sapiens* FUN14 domain containing 2 (FUNDC2):

(Seq ID No: 927)

ctccctcttccgctgccgccgtgggaatg

*Homo sapiens* ganglioside induced differentiation associated protein 1-like 1 (GDAP1L1):

(Seq ID No: 928)

cctccttctttcctgcctctgattccgggctgtcatg

*Homo sapiens* chromosome 19 open reading frame 43 (C19orf43):

(Seq ID No: 929)

agtcctttgcgcggcacctggcgacaaaatg

*Homo sapiens* MIS12, MIND kinetochore complex component, homolog (*S. pombe*) (MIS12):

(Seq ID No: 930)

ccctctcttctccaccagccaacgtccgggaaaaacgag
taagtacaggttccttctgccaatccccgccggcacagctaactttcccgcccggcccc
tttctgtcataattgaggtgtccacaaccagccaatcaggaacgcgagag
tatcccgcgtttgctttcgctcgccgaggcgcgtatcagtcggaattttggg
gagccaaccgcgccgtctgtccctggcaagccagcggcggtttaaaggaggtggcgg
gaagcctgtgtgtgcttcaaatcgtcaccctcatggtcgctccggtaagtgctgcgggg
cagcattttctctgaggaggagcggggacgggcgagactggcataa
gcgtcttcgcgagggagcaaggcggcctgtgggtcggcctcaccccggcctccgac
ctgaagatcccagcatgcagcgcgggcgcggggcccgacggaagccgggagccggccg
gaagcagttcctgcgctctggcttctgggtcctgtcctgcgcgatcgcggggtcttaga
cagctcaactcgccgagatgacctgggcacctctgcgttgaatcggcaaa
tactgatcaagccgcatttattctgctctcaggaactctaagtctagcagagaa
gatgaggcggtagaagttcatcaatggcttggctggaggacaagcaaattgaggacatt
ggcaacggagtgatcaaaatgatagatcatgaggcctaaaatgaataaggaaagaaga
gaagtggcagaggctgagaacagaaagagagggtggagggggctgtaaatcttgaa
gattagggtataatatgagtatatgggtaagaattggaagaattgtgtaggaggcag
tagtcaaaaagtagaagcagtttggaagagtagttacaaatatcaa
gagccaggtggctaaaaggtggagctataggtcattgaagctcaagaaactgag
tctctagggcattggttaagtcatctgtctagacttcaaagttgtctaggatga
taattcagaagactgatctgtgccaaagtcacaggtttttcac
gactgaaaacaacatagcaaaataagccaagatg

*Homo sapiens* DEAD (Asp-Glu-Ala-Asp) box polypeptide 50 (DDX50):

(Seq ID No: 931)

cttcctttcacgctgtcgctgcccgtaggtggttgtggccactgtgcccg
gagggaggcggcggtggccagtaatg

*Homo sapiens* chromosome 7 open reading frame 25 (C7orf25):

(Seq ID No: 932)

cggcctctgcgtgcacgcgcctgcgtgctcgcgctcgcggttctggcgctgccggaa
taatgctgacagcatg

*Homo sapiens* KxDL motif containing 1 (KXD1):

(Seq ID No: 933)

ccgccctttcctgtcgtgacttaacgcacgcaagcggctccagggtacgtccccgccac
gcgcgctcgcaggatcggtgcgtggtgacgtttcgccggcgcgggcgccatcccggaa
gcgcgagcaaggccgccagatgtgcaggcagcggaggaggagaaagagatg

*Homo sapiens* defective in sister chromatid cohesion 1 homolog (*S. cerevisiae*) (DSCC1):

(Seq ID No: 934)

acttctttcttgcccgccaagcccgcagccacccgggcgcggcgggactcctagacccgg
cgctgcgatg

*Homo sapiens* zinc finger protein 426 (ZNF426):

(Seq ID No: 935)

cgttcctttgtgacgccggctgtgagcgcctgagagtcttttgcctttcagagttaag
gcctcactggcctgggaaaataattgctgccttttgcatccgcgttggctccgtccccag
gatcttcccggttcagggacctggcgatttctgagtgttccggaatcccaataaccctgt
ttaaagaggaatggagattgccactgtccatttagattaatgaggtgtcctgaagtgatg
gtgacatcaatgaaaggagggttctgacacgttctcacctcgcgggatg

*Homo sapiens* TATA box binding protein (TBP)-associated factor, RNA polymerase I, D, 41 kDa (TAF1D):

(Seq ID No: 936)

caacccttttcttccgcacggttggaggaggtcggctggttatcgggagtt
ggagggctgaggtcggagggtggtgtgtacagagctctaggacaccaggccag
tcgcgggttttgggccgaggcctgggttacaagcagcaagtgcgcggttgggccac
tgcgaggccgttttagaaaactgtttaaaacaaagagcaattgatg

*Homo sapiens* PHD finger protein 1 (PHF1):

(Seq ID No: 937)

ccgcctcctcctcctgccgctgccgctgctttggctgctgcgtcat
acgccccagagccgccgggacggagggggctgggcctgggacccccggcctccgcctg -continued cacgccccccacgcccggacgtgccctctccgcgcggggactcgcctaggtctcc
tacgtctgccctgcccggctcccggcggcccagctgtcaccgcccccccaggatg
caatg

*Homo sapiens* family with sequence similarity 134, member A
(FAM134A):

(Seq ID No: 938)

cccccttccgcctgacgcgcccccggcggcggccgcg
cagccctggctcctcgcgggctcgggcggcggctgcggcggggctatg

*Homo*
*sapiens* membrane bound O-acyltransferase domain containing
7 (MBOAT7):

(Seq ID No: 939)

ccgcctcctttccggagcccgtctgttcccttcgggtccaaa
gcttttggctcctccttgttccgagcccgaaggcccgcccttcacgtactcg
gagctcggatcccagtgtggacctggactcgaatcccgtt
gccgactcgcgctctcggcttctgctccggggcttcttccctgcccgcccggggccctga
ccgtggcttcttccccggcctgatctgcgcagcccggcgggcgcccagaaggag
caggcggcgcggggcgcgctgggcggggaggcgtggccggagctgcggcggcaa
gcgggctgggactgctcggccgcctcctgcccggcgagcagctcagaccatg

*Homo sapiens* major facilitator superfamily domain containing
11 (MFSD11):

(Seq ID No: 940)

acgccccttttttgctcagccgtcagcccgctctccgtctgaagagtgcttctgccctca
tttgcctctccctgtgaccccggcccctcagactccgctgcgtcgtctctcggccccgt
ccagccgttcctgactgctcttcgccggagtccgcttcccaaccccctttcgccagagcc
cgagagctccgtcggctctgcgtcctggcggattgtcagtggcttcgccccgaggagagc
tgactgccctgggctgctgcctccggcagagctgagccaaaatg

*Homo sapiens* thiamine triphosphatase (THTPA):

(Seq ID No: 941)

ctcccttcccctctgtgggtcccgcgaggagactctcgggctttgaggtgagacctgaa
gttccgctggccgtagtgtagcaggaaagggcaggtcctcccggtcgtgagccagtag
cctcctggggtggcaaggtgtagagagggggcgttgaaaggacaccgctaccggcct
gctttctaggggtctctttggattgaggacatcagcagcagtggaagggattttactgga
gacctgtcactgtcagagccttaaaatatcaccgacggggccttaatgtcaccgaggtag
agagaaaagggcagtagccctagagactattgcgacacag
tgtgcccctcataagttttttcagggaggggttctgtactgagttgacgccccag
gagctgagcaccaggctttgcatccttgggaactcagcaaacgtttgttcagccaatt
gcaggtagcatg

*Homo sapiens* acyl-CoA synthetase short-chain family member 3
(ACSS3):

(Seq ID No: 942)

tactcccttccctcaggccccaggaagttgcaagagtaccatttgtcg
cacactcggggaccgcgggtggccggaggagatg

*Homo sapiens* chromosome 6 open reading frame 211 (C6orf211):

(Seq ID No: 943)

gctcctccttcgcggcggtaccgcctctgtttctgcggcgattgaacagccgagcttt
gcggccgggatcgcggaaagtgatg

*Homo sapiens* transmembrane protein 204 (TMEM204):

(Seq ID No: 944)

atttcctctctgctgagagccagggaaggcgagctctgcgcacacgggcgtccctgcag
cagccactctgctttccaggaccggccaactgccctg
gaggcatccacacaggggcccaggcagcacagaggagctgtgaacccgctccacac
cggccaccctgcccggagcctggcactcacagcaggccggtgctaaggag
tgtggcgcgggctcgactcccactgctgccggcctcccgagtgactctgttttccac
tgctgcaggcgagaagaggcacgcgcggcacaggccggcctccgcttcccgggaagac
ggcgcactcctggccctgggttcttgctgctgcccaccctctgctccctgg
gatgggccccgaggcgagcagcttcagcacaggcctggccctgctccaggtgcag
gaaggaggataaggccgggccgagaggcggcacacctggac
catcccatgggcctccgcccgcgccgccccgaggatgag
tggtgatgtcctctagccaccctagcagcgtcggctctccctggacgtgcggccgcg
gactgggacttggctttctccggataagcggcggcaccggcgtcagcgatg

*Homo sapiens* DEAR (Asp-Glu-Ala-His) box polypeptide 40
(DHX40):

(Seq ID No: 945)

tcgtctttcccctcccatctcctcagatcggtggacgtgctcgcctccac
tcggggccaggtctatg

*Homo sapiens* importin 4 (IPO4):

(Seq ID No: 946)

cctccccttttcggcccag
tagcggcggctcagttgctgccatg

-continued

*Homo sapiens* N-acetyltransferase 10 (GCN5-related) (NAT10):

(Seq ID No: 947)

ccttctctttcggagttgttccgtgctcccacgtgcttcccttctccactggctgg
gatccccgggctcggggcgcagtaataattttttcaccatg

*Homo sapiens* lin-28 homolog A (*C. elegans*) (LIN28A):

(Seq ID No: 948)

aaccctttgccttcggacttctccggggccagcagccgcccgaccaggggcccggggcca
cgggctcagccgacgaccatg

*Homo sapiens* CAP-GLY domain containing linker protein family, member 4 (CLIP4):

(Seq ID No: 949)

cggcctttcctccgcgcccccgcgtccccagccggccgctccgagaggacccggag
gaggcaggtggctttctagaagatg

*Homo sapiens* zinc finger, AN1-type domain 1 (ZFAND1):

(Seq ID No: 950)

ccgccccttacggcgccggagagatg

*Homo sapiens* GTPase, IMAP family member 6 (GIMAP6):

(Seq ID No: 951)

cctcccttttctcttccgaggctgcaaagtgcaacagcagactcttctgactcag
gaaggccggtgctcctacccacttcctgttcctccatctccagcggacac
tgctcttttcaagggcaggtctccagcccagctctctgaaaacattttgctgaaaa
tataagcaaacatcggccttgtcctccttgtgttcatacactgtggaa
gcttttctctgcctcctccgtgagagtgcgtggccgggagaccagaaac
gtggtcctttctcttgcctgtgagctggtgcagagatg

*Homo sapiens* thioredoxin domain containing 15 (TXNDC15):

(Seq ID No: 952)

cttcctccggctggcagcacgactcgcgtagccgtgcgccgattgcctctcggcctggg
caatg

*Homo sapiens* asparagine-linked glycosylation 9, alpha-1,2-mannosyltransferase homolog (*S. cerevisiae*) (ALG9):

(Seq ID No: 953)

aattctttttccccaggcttgccatg

*Homo sapiens* glutathione S-transferase, C-terminal domain containing (GSTCD):

(Seq ID No: 954)

acttcccttttccggtccgccggattatgaatgac
ggccggcgcgagtattttccacataaggtggctgtcgttttttctcctggcgtotgtg
gaggcgagtggtctgcgggcagcagctcccagaggcagccttggaattccagctcg
gactgggcgggaaggcgcaggcggcccaggtcgccgacacgctcac
gcaccctccctgcctggccgcgcgcctctgcgaccaggtgacccaatgaaagaagaaaatg

*Homo sapiens* CXADR-like membrane protein (CLMP):

(Seq ID No: 955)

actccttttctcttccaaacagggaaaagtgttccacgaagcgg
tagcgcctttccgcctcgcgttttcctccctgaccctggtccggctcccgtccgggcgc
cagctggtggggcgagcgccgggagcccatctgcccccaggggcac
ggggcgcggggccggctcccgcccggcacatggctgcagccacctcgcgcg
caccccgaggcgccgcgcccagctcgcccgaggtccgtcggaggcgcccggccgccccg
gagccaagcagcagctgagcggggaagcgcccgcgtccggggatcgggatg

*Homo sapiens* nonhomologous end-joining factor 1 (NHEJ1):

(Seq ID No: 956)

cctcctcttgcggtgggggaaagcggcctcttactctaggcctttcggtttgcgcgagc
gggcaggaaagcgtgcgtgcggctaagagagtgggcgctctcgcggccgctgacgatg

*Homo sapiens* gametogenetin binding protein 2 (GGNBP2):

(Seq ID No: 957)

cctccttcttccactccccgcggcgcgagcggctgactgcccgtagaggaaac
gacattcggagctgcgctcccgcccaggccggccctgacgcgggcctcgtcagccag
taacagggagcagaggtgggagttagcgaggcgaccacgaaaacggtgaaggtcggaac
cgacagcctcctccgagaagggcaggagctgggaggaggcggcagcggcggcgg
cagaaacagcagcggcggcggcggcggcagctgggaggaggtggtgacggtggcaacgg
cagcgtcggggacgatg

*Homo sapiens* zinc finger protein 672 (ZNF672):

(Seq ID No: 958)

cttttctcttttagccccgcctgcttcccggctccagctggggccggagaggctgag
tggttggtacgctgctcgctggcctcccagtcttcccagcaaccggtgacac
tgccgcgccagactgaccactagccgacgcgggcgagagggacaggagcgtgac
ctccccatcccgaggggccggacgctcgggcgcctccccgctcccccactcg
gaggccgcgcgcgccgttagccccttcctcgctccccgcccagtcccgcagtccgg
gaggcggggtcggcagccggctgagtgggaaccgcgcggtgtctgaggaggcag -continued
tcggcgaccggtttccacttcaagcgtgacccttttgcctgtgggatgagctccag
catgggtgaggtacagaagagagacttgaagagcgtgccttgggactcaa
gcgccaaacctgtaccctagcgagtgtcctactccgcatccg
taatggaaggaaatgcacatcttactccagaggcacaagaggaggacatcccatgcggc
tactcctgcccagcgtggtggggcagcagaagctccagagcccagacttgcaggctcac
ggtgcagggtgaacctggccacagctcaccctggaacagccacaatgtctgcccctta
gagaagaaccctgaaatcagaccagttttttgcggcctcccccttcctctctgttacag
tgcccttttccaggccttaagagaagtaaaacttagctgcagcgccaggaggtg
gaccccagagtgtgagtggcacgcttccctgtgaacccgtcctcaccatg

*Homo sapiens* N(alpha)-acetyltransferase 60, NatF catalytic subunit
(NAA60):

(Seq ID No: 959)

ccgcctccgtcccggctgcggcccctgccggttacataactcgtt
gcgggctccgcgcggtcccactttcccggctcccttcgcctccag
gatgcgctgagcccaacaacacccccagcggccgccggctcccccacgaggtgtgaatg

*Homo sapiens* transcription elongation factor A (SII)-like 4
(TCEAL4):

(Seq ID No: 960)

tgccctctgtccccgcggctgggtctcgtctgctccggttcctgggctcctaattctt
ggtccagcttcttccaggtcagtgtgcgggccttccacgctgccagcggaacactg
gaatggcggaaggggaacgggtctgcgcgtctgttgttcccagcgctctgcgaa
gcctgaaaaggaggagcaacctgtccagaatccccgcaggacaggaaaaggaggg
gaaatctcgacatg

*Homo sapiens* progestin and adipoQ receptor family member VI
(PAQR6):

(Seq ID No: 961)

tcccctttgtctctcccccactccccgcccaggcctggcccgcctgcctggccactcttcctc
catcagcctggctggcagcagccttggactccgcccgtggagccctgggcctgttgaccc
accagcttaggagcacccaccaagctctgggtaaggaagctcaccttctggggctcttct
gggaaaatagaggtcaacgtggaggtaccaggccaccatgctcagtctcaagctgcccca
acttcttcaagtccaccaggtcccccgggtgttctgggaagatggcatcatgtctggcta
ccgccgccccaccagctcggctttggactgtgtcctcagctccttccagatgaccaacga
gacggtcaacatctggactcacttcctgcccacctggtgagggaggctctgccccaggc
cgcggccttgagctcagagggggtacccaggcgggcaggaccgtccaggcccacgggct
gcagcggcagtcgcgggggtccgcggcggcctgagcacgcgcccgccgcaggtacttcct
gtggcggctcctggcgctggcgggcggccccggcttccgtgcgggagccgtaccactggcc
gctgctggtcttcctgctgcccgcctgcctctaccccttcgcgtcgtgctgcgcgcacac
cttcagctccatg

*Homo sapiens* DENN/MADD domain containing 2D (DENND2D):

(Seq ID No: 962)

catccttcttgctcaaccactgggtgcacaggatggaaacttctattccctctctg
gaagacagcgcgtggcttggcttcacagagttgtggctggagaccgaa
gcagccccttctcaggcttactgtcaccagtctgtctgtgttaggggagaggggag
tccgctctgtcctgaaggcccagagatg

*Homo sapiens* family with sequence similarity 188, member A
(FAM188A):

(Seq ID No: 963)

ccttcttctttcctgcctcaccttccaattcgttt
gccgccgccgtcccgcagctgctgtttccggagttgcccctccccatgttccgggg
caggagtccgcaaagcgaagatccgcccgccggttcctcatcatg

*Homo sapiens* neurensin 2 (NRSN2):

(Seq ID No: 964)

ccgcctttgctcggcggagacag
caggcagagagatgaggaaactgagacccagaaaggtggaagcacttgtctaaggtcac
gcctccaggaagcagtgtgtccacgactccag
tccaagtggtcaggctccagagcccacagtcccaggggtccatg

*Homo sapiens* tripartite motif containing 46 (TRIM46):

(Seq ID No: 965)

agccctcctcacacccccactgggctcctgcattaagcccggggttcgcagccg
cagccgggatcgggcacccaggggcgggcgggcacggtagggccatg

*Homo sapiens* target of EGR1, member 1 (nuclear) (TOE1):

(Seq ID No: 966)

catcctctctgggaatttaccgatgcccagaacgcccttctttcccccacac
gaccctctcctagtctaactcctgggcgtgctttaagctcagctcaggcggcgtcac
cttctctggaaagcccaaacccagccaccccactacccgctacccgcggcccac
gctgatgaagacagcagaacacggaggccccgcgttcccgccgcgagagcaggaga
gaaagattacctcccgcgagctctagcgcgcccggctttccggcgcac
tccagggggcgtggctcgggtccacccgggctgcgagccggcagcacaggccaa
taggcaattagcgcgcgccaggctgccttccccgcgccggacccgggacgtctgaac
ggaagttcgacccatcggcgacccgacggcga
gaccccgccccatcccgacgctgaaccgcgccaggagacggaccgcaagtccagcg
tacccacagacgactcaggcggggagacgagcggtgtcatg

*Homo sapiens* DBF4 homolog B (*S. cerevisiae*) (DBF4B):

(Seq ID No: 967)

cgttcttttaggggtggagccggcaggaaatttaaactgaagccgcggccgaaaacgcca
agagattgatgctgtagctgccctgagataaccaggactgtggaatcgggaa
gagctcatggagctcgcgaatgtaatacggaggcctctgaggaaggagtac
ggaggccgagaaggagccggcatttgatg

*Homo sapiens* myc target 1 (MYCT1):

(Seq ID No: 968)

atttccttttatg

*Homo sapiens* myosin XIX (MYO19):

(Seq ID No: 969)

ggttcctttcctcactgcacgctctt
gcccctcctcttttctctcctgcccgtgttcttcccgccgcctgac
ctggcccgcccgcctttccagtctggccgggcggggcctgaagcacggcggctcgggcc
gtgggaccgtgttcacacccttccagaaattcttggctggtaaccgcgaaaccgactgg
agcaggagctgggagaactggagaaaactgctctaatctcacttgactccagctaggagc
tgatgctgcatcgtaataacatttgcagagcgctttcacaggcgctggagtgacttgtct
gagattcctccagaactgagccctttgttggaaccataccccagcccatggtcccatgac
taggtggatagtactccttgtacctcctgcaacccagaaccctggctgaccacttttgaag
gaggatg

*Homo sapiens* KIAA0226-like (KIAA0226L):

(Seq ID No: 970)

cctcccctttctgctgttaccgggagcgcggtggccacggaacgctgcccg
gagccgcgcgagggaggacccgacgcgcggcgtttacccagcgcagcgttccac
cgctcgggtttggctggataaaataaaaaatggggatattgacctcctgtcactactg
catgggactttgatggtttccaatcattactttctcctctgtgtcaatctgcctcttcga
gaaattcatactcctgaatagctctccagacccccagctggccatgtggtgag
ttcagggcccaaatcaagtagtaccagcaatcagggaactcctatctgtttt
gaatggattcacaccagccacaagcctggaaagatg

*Homo sapiens* MUS81 endonuclease homolog (*S. cerevisiae*) (MUS81):

(Seq ID No: 971)

ctccctcttcccccgccccgccctgggccaggtgttcgaatcccgactccagaactggcg
gcgtcccagtcccgcgggcgtggagcgccggaggacccgccctcgggctcatg

*Homo sapiens* zinc finger protein 430 (ZNF430):

(Seq ID No: 972)

gggcctttt
gtccctcgctgtggcctgagctccaggtctcgtcttcagcgctctgtgtcctctgctcct
agaggtccaggctctgtggccctgtgacccgcaggtattgggagatctacagctaagac
gccaggaaccctggaagcctagaaatg

*Homo sapiens* mutS homolog 5 (*E. coli*) (MSH5):

(Seq ID No: 973)

gctcctttt
gcaggctcgtggcggtcggtcagcggggcgttctcccacctg
tagcgactcaggttactgaaaaggcgggaaaacgctgcgatggcggcagctgggggag
gaggaagataagcgcgtgaggctggggtcctggcgcgtggttggcagaggcagaga
cataagacgtgcac
gactcgccccacagggccctcagaccccttccttccaaaggagcctccaagctcatg

*Homo sapiens* proline rich 3 (PRR3):

(Seq ID No: 974)

gcccccttcctcac
taccctccaaatcccgctgcagccattgccgcagacacgatg

*Homo sapiens* sirtuin 2 (SIRT2):

(Seq ID No: 975)

cgcccctttaccaacatggctgctgac
gccacgccttctgggactcgtagtccggtcctcgcgcgctttcttac
ctaactggggcgctctgggtgttgtacgaaagcgcgtctgcggccgcaatgtctgctga
gagttgtagttctgtgccctatcacggccactccatttctggtgccgtcacgg
gacagagcagtcggtgacaggacagagccagtcggtgacgggacacagtggttggtgac
gggacagagcggtcggtgacagcctcaagggcttcagcaccgcgcccatgg
cagagccagaccgactcagattcagactctgagggaggagccgctggtggagaagca
gacatg

*Homo sapiens* KIAA1715 (KIAA1715):

(Seq ID No: 976)

ttgtctctctgtcagtggcggtgctgcctgctctggaggcaggctgggcggtggcggcc
gagactggcgggggtggacgcccgggccgggctgcgcccgcttctt
gcagctgtgaattccttggacaattgatgatatttatcattgtgcccagtttc
tacaaataaagatg -continued

*Homo sapiens* proline-rich transmembrane protein 1 (PRRT1):

(Seq ID No: 977)

ctgccttcatctctccatctctgcgctgctgccggctgcgccatccag
cacccagactccagcaccggccgaggaccccactccggctg
cagggaccctgtcccagcgagaccgcaggcatg

*Homo sapiens* t-complex 1 (TCP1):

(Seq ID No: 978)

ccgcccttccccggagcctcac
ttccgtcacagtcctgtttctctccctgtt
gtccctgcctcttttccttcccgccgtgccccgcggccgggccggggcagccgggaa
gcgggtggggtggtgtgttacccagtagctcctgggacatcgctcgggtacgctccac
gccgtcgcagccactgctgtggtcgccggtcggccgaggggccgcgatactggtt
gcccgcggtgtaagcagaattcgacgtgtatcgctgccgtcaagatg

*Homo sapiens* Yip1 domain family, member 5 (YIPF5):

(Seq ID No: 979)

cgttcttt
ggccctgtgacacgtagcaacggggctggttcagggtctgaaacagagtttgggggtt
gtttgggattagtgaagctactgcctttgccgccagcgcagcctcagagtttgat
tatttgcaatg

*Homo sapiens* glucose-fructose oxidoreductase domain containing 2 (GFOD2):

(Seq ID No: 980)

cctcccttttccagagcccccagttccttagaaac
caggcggcgcgttcccggtggcggcgccctggactcccgggcccgcg
catccccgccagccttccttaaggcggatgggtggccccgagaccccgtcg
gacccatggtttccagtgcagcgcggagtgggcgatgccagcgtgccag
gagccatgtctgaccaggacgtttggaagatcatatccatgccagaggctcttgtgag
gagatgagttggtaaagagagaggctgggatg

*Homo sapiens* apolipoprotein L, 2 (APOL2):

(Seq ID No: 981)

ttcccttttcgaattccagggtatatctgggaggccggaggacgtgtctggttattacaca
gatgcacagctggacgtgggatccacacagctcagaacagttggatcttgctcagtctct
gtcagaggaagatcccttggacaagaggaccctgccttggtgtgagagtgagggaagagg
aagctggaacgagggttaaggaaaaccttccagtctggacagtgactggagagctccaag
gaaagcccctcggtaacccagccgctggcaccatg

*Homo sapiens* microtubule-associated protein 4 (MAP4):

(Seq ID No: 982)

ccgcctccctgcgcccgcccctccggctagctcgctggctcccggctcctcccgac
gtctcctacctcctcac
ggctcttcccggcgctctcctggctcccttctgccccagctccgtctcggcggcggcggg
cagttgcagtggtgcagaatg

*Homo sapiens* exonuclease NEF-sp (LOC81691):

(Seq ID No: 983)

cttccttctttt
gccaggcagacgcccgttgtagccgttggggaaccgttgagaatccgccatg

*Homo sapiens* ST6 (alpha-N-acetyl-neuraminyl-2,3-beta-galactosyl-1,3)-N-acetylgalactosaminide alpha-2,6-sialyltransferase 5 (ST6GALNAC5):

(Seq ID No: 984)

ctgtctctaatctctg
caacagccgcgcttcccgggtcccgcggctcccgcgcgcgatctgccgcggccggctgct
gggcaaaaatcagagccgcctccgcccattaccatcatggaaaccctccag
gaaaaagtggccccggacgcgcgagcctgaggattctgcacaaaagaggtgcccaaaatg

*Homo sapiens* heterogeneous nuclear ribonucleoprotein A1 (HNRNPA1):

(Seq ID No: 985)

tgctcctttctgcccgtggacgccgccgaagaa
gcatcgttaaagtctctcttcaccctgccgtcatg

*Homo sapiens* zinc finger protein 93 (ZNF93):

(Seq ID No: 986)

gggtcctt
gtctctcggtgcagccggagctccaggtctcctcttcactactctgtgtcctgtgctcc
tacaggcccagcctctgtggccctgtgacctgcaggtattgggagatccacagctaaga
caccaggacccctggaagcctagaaatg

*Homo sapiens* N-terminal EF-hand calcium binding protein 3 (NECAB3):

(Seq ID No: 987)

cggcctctagccacaccgagtccgccgcggcgtccagggtcggcag
caaccgcagccgagcccgagcgggtggcggcgccatg -continued

*Homo sapiens* splicing factor 3b, subunit 5, 10 kDa (SF3B5):

(Seq ID No: 988)

cattcttctgcgacggcgcggacctggagcttccgcgcggtggcttcactctcctg
taaaacgctagagcggcgagttgttacctgcgtcctctgacctgagagcgaaggggaaa
gcggcgagatg

*Homo sapiens* INO80 complex subunit B (INO80B):

(Seq ID No: 989)

gtccccttccctcgcaggacctcatg

*Homo sapiens* polyamine modulated factor 1 binding protein 1 (PMFBP1):

(Seq ID No: 990)

ctttcttcctcttggcttatattagggatagggggatgtggttt
gttacaaaggatgagtattttgatagcttctcattccttgaactattctg
caggtttataacaaagctcagaaaatactaaaggttaaaggagaattga
gagctgccaaggaaatg

*Homo sapiens* pseudouridylate synthase 3 (PUS3):

(Seq ID No: 991)

cttcctttctcggaaacgcggcgcggccggctgccggaaaacagggcagacctgtatggt
tcgtttattcctggggttgtcatatcatg

*Homo sapiens* heterogeneous nuclear ribonucleoprotein D (AU-rich element RNA binding protein 1, 37 kDa) (HNRNPD):

(Seq ID No: 992)

tattcttttttagtgcagcgggagagagcgggagtgtgcgccgcgcgagagtgg
gaggcgaaggggggcaggccagggagaggcgcaggagcctttgcagccac
gcgcgcgccttccctgtcttgtgtgcttcgcgaggtagagcgggcgcgcgg
cagcggcggggattactttgctgctagtttcggttcgcggcagcggcgggtgtag
tctcggcggcagcggcggagacactagcactatg

*Homo sapiens* GABA(A) receptor-associated protein like 1 (GABARAPL1):

(Seq ID No: 993)

atttctccatctggctctcctctacctccaggcaggctcacccga
gatcccgccccgaaccccccctgcacactcggcccagcgctgttgcccccggagcg
gacgtttctgcagctattctgagcacaccttgacgtcggctgagggagcgg
gacagggtcagcggcgaaggaggcaggccccgcgcggggatctcggaagccctgcggtg
catcatg

*Homo sapiens* chromosome 22 open reading frame 13 (C22orf13):

(Seq ID No: 994)

ccttcctttccccagtgttgagcgcggtctcgcctccgcttcctcctcac
tccgcctgccggctgggaaaactagggcaccagtacgatagttccggcaccggaaaa
gagggctgatgactgggcccgggggccgccgcaacgacccttggggcggcaaa
gagccagagagggtgctcacacttccaagcacccccacaccaaggacaggctggacgg
caaggcggagacgcggggcttgggccctcagaccggggacagcaggaggtt
gggcaagggccaggacttcccgtcacaatttcatttgttgatcccggcac
cgccaggtaagggggccctgagtgaggctaggtatctggtacgga
taaagttaggtatagagtagagcggctgcccgctcagggttatccctaaagacagtt
ggaggagagttgcttggggcctcggggatgcactgggcgggatcagggcttacacctag
gactggcaaaagagcgggaccggcagaggcggggcttgccgaagggacgagcctc
tattcaggaaatgcacgagctttgggcggggctcaaa
gaaaggggcggggcttccggggcccgcgtcctggtgagctgcgcgtctgcgcgag
gattgggcgagagggtggggccactcaacgctgaggcggcgaatggccggag
cagacttaaatcaagaggctggggaccctctaagatcaaagttt
ggggcggggcctaaggaggggcggggcctccagattcgagacctg
gaaggctggggcggcgcttggggcggccctgccgccgcctcccgttctcccctccg
cagcggcggcggtggcggagaaggaactcgacacgcaccgac
cgccctcccgccccagccgaagcggaagctg
tagcccgctctgggccggggccatgggcgccccgcgccgcccgggtcatg

*Homo sapiens* lon peptidase 2, peroxisomal (LONP2):

(Seq ID No: 995)

ggctcttttttgacagcccccagtgcgaaaggctgccagcatg

*Homo sapiens* RNA binding motif protein 4B (RBM4B):

(Seq ID No: 996)

ggttctctctgacgtgggagccgccgtcgctgccgccacccggaggctcttgtcaggatg

*Homo sapiens* protocadherin alpha 3 (PCDHA3):

(Seq ID No: 997)

aggtcttctctccacaaaagaaataacagcgtgcattacgtattcagatactgctttgctt
catcctctctaaaatttaacaccgaggagtttaagaaatgaaga
taaggaactcgaattattttttaaactttggatcaatgtaaaggcaatctaatattt
ggaaaatacttgcaatg Homo sapiens RAB34, member RAS oncogene family (RAB34):

(Seq ID No: 998)

gcctctccttgggcccttctctccccctttccctccctgctggttcctgg
catcgccagatgctgcgcagcagtctccgattccccatcac
caattcggctggcgtctccgagaccgcggactcccgtagggtccccgtggccccgagtt
gtagtcgggacaccccggccgcgggtgatcgtcgggtctccac
gcgcccgggtcgctgacgcggatccggcctcggcgccttctcagggcgccctg
caaggccgcaggcaggatg Homo sapiens cell division cycle associated 7 (CDCA7):

(Seq ID No: 999)

gctcctcctgctgtgggaccgctgaccgcgcggctgctccgctctccccgctccaa
gcgccgatctgggcacccgccaccagcatg Homo sapiens ArfGAP with GTPase domain, ankyrin repeat and PH domain 3 (AGAP3):

(Seq ID No: 1000)

gggtcttttaggagagcactgctgcagccggcagtgga
gagcctgggcagggagacagggagaaaactccggcagcagggtggtctctagggctgac
ctcggagcctggggacaggggagcctatgccgcactgaaggcgggacgctgtaagcgag
gagcagctgggcctgggcggactcctcggccaatcagcctcggtcagcag
caccctcaggcgcagggcactgtttgggcattgcctaga
gatccgacaccccgcccagatcagcgcagggaggcgaaagcgacagccgggcgcgggag
gagaccaggg
cagctgtccctccgcgagggtggccctcgaggcaatgcgggtgggggctggtgag
gaggcggaagggccgaggctgagtgggaggggccggggcgccagggctg
gagcgcgcggctcgggggtggaggctg
cagagccagcgagcgagcgaggggcggggcgcccggccggcgcgcag
gaggggcggggcggcggggaggggggctcgggctgcgtgtgccg
gagccggcggggcggcggtgcgtgcgcatgacgcggggg
gagggcctgggccgcgcgctcccggtcccgttgttgttgccgctg
gaggctgctccgaggcagcgggatcacgcgctgggaagcgctcgg
cagcggcggccacagcgtgcgcggcggcgcctcctggcctcggcctccggccccggccc
ccggctccatgcgctagccccgcgccgccagcccagtag
tcccggccccgccagcccgcgctcccgctcgccgctgccgccgccgccgccgccgc
ctccgccgcgccgcccccgggcccgcctcgggcccacggctccgaagccatg Homo sapiens potassium channel tetramerisation domain containing 10 (KCTD10):

(Seq ID No: 1001)

ctgcctctctcagtccgggtttggagactcctgcgtcctc
cgacttttcatg

Homo sapiens cyclin B1 (CCNB1):

(Seq ID No: 1002)

cattctctgcgaccggcagccgccaatgggaagggagtgagtgccacgaacaggccaata
aggagggagcagtgcgggggtttaaatctgaggctaggctggctcttctcggcgtgctgcg
gcggaacggctgttggtttctgctgggtgtaggtccttggctggtcgggcctccggtgtt
ctgcttctccccgctgagctgctgcctggtgaagaggaagccatg Homo sapiens eukaryotic translation initiation factor 2A, 65 kDa (EIF2A):

(Seq ID No: 1003)

gtttctctttccgggacaacatg

Homo sapiens protocadherin gamma subfamily B, 7 (PCDHGB7):

(Seq ID No: 1004)

cagcctctagcctgggattccctgcgcagccaacaacagaaaagaaaac
cagctcccacacagaggctcccggctgcgcagaccttgcccagcacac
cagattgccagctccgagacccgg
gactcctcctgtcctgggccgaatgctcttttagcgcggtagagtgcac
tttctccaactggaaaagcggggacccagcgagaacccgagcgaacgatg Homo sapiens acyl-CoA dehydrogenase family, member 11 (ACAD11):

(Seq ID No: 1005)

ggctctttcggcttccttcctcgctgggccggctaaacccggccgcag
cagcaccggggtgataagtgtccagggcaggaggccagcgatgttgccttgctaac
cgggtatctaagagaaacagggtcttttattcttaggctcgacagtctgac
ggccttttttctgaacgggaccctgcaggtcttccgcctgctgttgcattaaattt
gggggtggaagaggcttctgcgttgttccttacccgcaacgatgaccatggctttt
gccttctttaaaattgaggcctccaactctgacgctgactggagaatt
gaaacccgaacacacattgggctcttttggcacttgactagagctaaaacctcgggat
tcagcgggcaagcgttgctcagcaacggcgcgtaggctgtgtgcggttggctg
gagccagaccccaccccggcctcggcccatgctctagagggacgtt
gccccaatcctgaaggacttcggcactcgagacctgtggatgccgcgtt
gctgtggcctgcgggggtgatcatg

*Homo sapiens* zinc finger, CCHC domain containing 7 (ZCCHC7):

(Seq ID No: 1006)

ccgtccctctacgcgttttggttcccggttggtgcttcctgttcgcagctgcggcac
ttcaaggttactgacttttatg

*Homo sapiens* zinc finger, MYND-type containing 12 (ZMYND12):

(Seq ID No: 1007)

gggcctttctggacttggactccttgggagtcgtttctcggccatttgacccgtgg
gacttgtgggttttgtgctgcttttctttctttcttcccctttccaacttcag
caatacacccagatgttagtcgagtcacgtcccgccgccctctgcccttgaaatgctgg
caagtacgcagcccgcgatcgtcacgtgacgccggggttcagcgtatccttgctggg
caaccgtcttagagaccagcactgctggctgcaccatg

*Homo sapiens* forty-two-three domain containing 1 (FYTTD1):

(Seq ID No: 1008)

cgctccctcggtgcggcgggctgcgtgcgcgagtgggaggtgg
caggcctgcgactccggccttgtccgcgcccgctctcggcgcgacgtctccagccatg

*Homo sapiens* SH3-domain GRB2-like (endo-
philin) interacting protein 1 (SGIP1):

(Seq ID No: 1009)

ctcccttctctcagcatcttcttggtagcctgcctgtaggtgaagaagcaccagcagca
tccatggcctgtcttttggcttaacacttatctcctttggctttgacagcggacggaata
gacctcagcagcggcgtggtgaggacttagctgggacctggaatcgtatcctcctgtgtt
ttttcagactccttggaaattaaggaatgcaattctgccaccatg

*Homo sapiens* GTPase activating Rap/RanGAP domain-like 3
(GARNL3):

(Seq ID No: 1010)

cagccctttttgcaaatg

*Homo sapiens* DCN1, defective in cullin neddylation 1, domain containing
5 (*S. cerevisiae*) (DCUN1D5):

(Seq ID No: 1011)

gagcctcttgctt
gctgtgactggtggagctgccgcgctgtccgcgttatctcctcccggtgagaacgaac
cgcagtgtccaccggcgaggagccagccctgtcccggtcagagaaagacgacgagga
tacctgg
gagcgggcggcggccgggctgggccgcgccggtgcgggctggcgactctgctcctccgct
tgctgctgtctctgggaactgggtgccagcgctgaggggcttccagcg
gacagggaccccccttccccggctcccctgccaccctgccggggagggcggaagatg

*Homo sapiens* alkB, alkylation repair homolog 7 (*E. coli*)
(ALKBH7):

(Seq ID No: 1012)

tgccctctctcatgacccccgctccgggattatg

*Homo sapiens* nitric oxide associated 1 (NOA1):

(Seq ID No: 1013)

ccgcccctttt
ggagctacttcctcatg

*Homo sapiens* BTB (POZ) domain containing 10 (BTBD10):

(Seq ID No: 1014)

tcgcctcttcgcattgtgagctctcgcggtaagaggctgaggagccggcctgcaac
ctgccggggcggctccgctacgcgcagccgcctcagtggcttcctccacagccac
ctccggagggatctggctgaggaggaagtggaggtgtcactggccccggccttt
gccccaatcttgtgtgggcactgaaggggactacaggttcgagagttatgggtgc
tacatgtgtgctttcagagcagtagtgtgaggaagcttggagtgggatg

*Homo sapiens* zinc finger protein 397 (ZNF397):

(Seq ID No: 1015)

cggtctttt
gtggcttgcagctcggggtgggtggctcatttcctggccgctcctgggcttcgcggaaa
gaagagattactcacactccttcgcaagcacagaaccagttgtactgagcttttt
gctaagctgtttcagccaagaatg

*Homo sapiens* mitochondrial ribosomal protein L45 (MRPL45):

(Seq ID No: 1016)

gctcccttcccggcggcctttgcgggaacaagatg

*Homo sapiens* AKT1 substrate 1 (proline-rich) (AKT1S1):

(Seq ID No: 1017)

cttccttctccatattgtatactggaattgaagccaaggaggtaccattttgctcgaggg
catggcctaagccggtcagctaaggccatgttaatacggggctgtcccatctctctgcgg
ggcgcgacagctggaagagccgaacggataagagaagaggaggtgagaggagctgtacac
cacaagaggcactgagggactcaggataacggatgaagccgtcagtgccccagaaacg
aagcggcccggacgaattctgagtcaccgtcgcgagaaagcgggctgagccgccattt
tgaagcctggcaaaccgaagcaagaaatgctgccgtgttggatctttgccagccttcgtg
ccgaatgggagcaggttggagggagggagagccaatatacactatgggctgattaagccc

```
ggttggctgccatgttgttaacgagcaccgatttcctctactttgtcgaagaagtttat
tgtgggtcagggacgtcaggtcgcttgccttcgtttactgtggtcatgattgagcatatg
aggacgggcattattgttgggggcaaatggaaatgctctaggcggggccattttcttag
gggcaagctgtcgtcacccttgtcaactggttcggatgaagcccctgtggccgccatctt
gatctcgggcggccccgataagggaggcggagtgtgcggagaggaggcggggcaactgcg
cggacgtgacgcaaggcgccgccatgtcttttgagggcggtgacggcgccgggccggcca
tgctggctacgggcacggcgcggatg
```

Homo sapiens transmembrane protein 101 (TMEM101):

(Seq ID No: 1018)

ctgccctttcccaagatg

Homo sapiens eukaryotic translation elongation factor 1 delta
(guanine nucleotide exchange protein) (EEF1D):

(Seq ID No: 1019)

```
ggccctcccttttcatcagtcttcccgcgtccgccgattcctcctcctt
ggtcgccgcgtccttggctggcgttagagacagggtttcaacgtgttagccag
gatggtctcagtctccagaccctgtgatccgcccgcctcggcctcccaaagtgttgg
gattacaggtgtgagccaccgtgcctggccgaggctccttcttttatg
```

Homo sapiens ADP-ribosylation factor GTPase activating protein
2 (ARFGAP2):

(Seq ID No: 1020)

```
cgccctccccgccgtggattggcccgcggcgg
gacccgtcagccgcggttgtgtctgggaaggagagaaaatg
```

Homo sapiens junctophilin 4 (JPH4):

(Seq ID No: 1021)

```
atttctctcctccctgggggtctcagtg
catctccttctcctctctgcctgcctcctccctcaccgaagggttagcg
gacacccatcctttctgcttggggaccccaccaccaccgcaacac
tgccgctgtctcttcttcaccgtatccttctc
tacccaccctcttctctcttctttctccctgccccttaaatctgcctggcccagcctc
ccccgtgatgctgggatggagcaaacattgatttgtgctgggatggaatcggaatttt
gatttattttcctctcccaaccataagaagaaaaaaataataaaaacacccctctctt
gagagccccctccccttt
gcatccagctcccagctcttcttccctatctccatccaaggcagat
tttttcccctacactattctcatcttcccccacccttgccactac
ctcgccccccaccagcctgctcctccagctgggagagaggggactctccg
gactcccccacctttcctctctggggtttggagcagtctctccggaaggggagggggctt
ggcttgtccgggcgaggtgggagtggaggtatcctgccatggatgctgtgccggg
gaggcagcctgagcccagcccacatgagacgccgaagaaccgggg
cagaggggtcctgacagcagccagggaaacgggtgccctacgat
tctgcccagccccctctcaggaccccaaactgccatccacactcgacac
ttcggggttctagccactcag
gatgagggtccggccctgcctgccctcgctgggggcccccgccgccgggccccggtctaact
gcccccgccccgaggcctcgcccggctccaaggccccagcaggctctccagtcccag
gatgcgctgagccgccgggggggctgaggccgcgccaactacatgcatg
```

Homo sapiens embryonal Fyn-associated substrate (EFS):

(Seq ID No: 1022)

```
ttttcttctcctcctccaaccttggcggaggccac
gactcaggcgccacagctggggctagaggccgcggaccatggtgcggggcagccac
cgctgaagtcagcaaaaccgagcctggcctgaggcaggctgcgcgggaggccaaagc
catg
```

Homo sapiens GH3 domain containing (GHDC):

(Seq ID No: 1023)

```
cgctccttctttctggccggatgtgtgctgagacccagag
tcacccaggggtctccgtcacgtgccaggagtaggcagaagtgggctgtgacagatcag
gaaacagagctcagtgcagcccactaaattgctcagggccctacagctaacaagcgg
cagaggcaggatctgcactcaggagctgcttggagatg
```

Homo sapiens acrosin binding protein (ACRBP):

(Seq ID No: 1024)

```
ggctctctctgcggcttggcccgttagaggcggcttgtgtccacgggacgcgggcg
gatcttctccggccatg
```

Homo sapiens jagunal homolog 1 (Drosophila) (JAGN1):

(Seq ID No: 1025)

```
ag
ttctcttcacggagccgcgcggctgcgggggcgcaaataggtcagtgggccgctt
ggcggtgtcgttgcggtaccaggtccgcgtgagggggttcgggggttctgggcaggca
caatg
```

Homo sapiens ligand of numb-protein X 1, E3 ubiquitin protein
ligase (LNX1):

(Seq ID No: 1026)

```
gttcctttcctgggcatcagcttgcctgctctcagcctaa
gctctctcgccaaccgtggtggctccttgcgttcctacatcctctcatctga
gaatcagagagcataatcttcttacgggcccgtgatttattaac
```

-continued
```
gtggcttaatctgaaggttctcagtcaaattctttgtgatctactgattgtggggg
catggcaaggtttgcttaaaggagcttggctggtttgggcctt
gtagctgacagaaggtggccagggagaaggcagcacactgctcggagaatg
```

*Homo sapiens* cyclin-dependent kinase 2 interacting protein (CINP):

(Seq ID No: 1027)
```
tctccttctacggatatctgtggaccttatg
```

*Homo sapiens* splA/ryanodine receptor domain and SOCS box containing 2 (SPSB2):

(Seq ID No: 1028)
```
gcttctttccgcccggctccttcagaggcccggcgac
ctccagggctgggaagtcaaccgagctcccttccaggtcaatccaaactg
gagctcaactttcagaagagaaagacgccccagcaagcctctttcggggag
tcctctagctcctcacctccatg
```

*Homo sapiens* Berardinelli-Seip congenital lipodystrophy 2 (seipin) (BSCL2):

(Seq ID No: 1029)
```
cctcctcctttcctccctctactctgacacagcacttag
cacctgaatcttcgtttctctcccagggaccctccattttccatatccag
gaaaatgtgatgcgccacaggtatcagcgtctggatcgccacttcac
gttttagccacaagtgactcagtggaagatccagagtcaacagaggctcgtcaggaa
gatg
```

*Homo sapiens* tubulin, alpha 1c (TUBA1C):

(Seq ID No: 1030)
```
caccctttcactacttctcccccggactccttggtagtctgttagtgggagatccttgtt
gccgtcccttcgcctccttcaccgccgcagacccccttcaagttctagtcatg
```

*Homo sapiens* 1-acylglycerol-3-phosphate O-acyltransferase 9 (AGPAT9):

(Seq ID No: 1031)
```
tttccttcctctcttcccttcgcagaggtgag
tgccgggctcggcgctctgctcctggagctcccgcgggactgcctggg
gacagggactgctgtggcgctcggccctccactgcggacctctcctgag
tgggtgcgccgagtcatg
```

*Homo sapiens* 1-acylglycerol-3-phosphate O-acyltransferase 1 (lysophosphatidic acid acyltransferase, alpha) (AGPAT1):

(Seq ID No: 1032)
```
gccccttctttccttcgcttcctcttttagagaatgtccggattgctattggactttt
ggagcgtatggctccaaatcaactcattggctaaaacttgac
ggaaaatggtggttaggtggccagaatg
```

*Homo sapiens* abhydrolase domain containing 14B (ABHD14B):

(Seq ID No: 1033)
```
cggcctcttcccagcgttcctcctccggccccaggtcaccgccagcac
gcgcctgcttcccgtctgcgcgagtccacgcagctcccccagatcaagaa
gctgaggcccccaggttacacactaaagtaaatgcagaggcagaaataacac
ctatgtcctcctgaccccaaggcatgttcttaaagttctggaaacctcctg
gaggcttccttgctgctcctctgggactgccaccctggg
cagggtgttctgtggcccctcatcatcgtggttttgaaccacaggcccttcaccag
cacagcagcagcaggcatg
```

*Homo sapiens* protein tyrosine phosphatase, non-receptor type 5 (striatum-enriched) (PTPN5):

(Seq ID No: 1034)
```
catcctcccgccagcctgcccgcctgctcgccggcgcccggagcccgctctggccgctt
gcttttgctgagaaagcttcctgccctggaagatggcacccttcccatccagacac
cttgggaatg
```

*Homo sapiens* carbonyl reductase 4 (CBR4):

(Seq ID No: 1035)
```
cttcctcctttcac
ggcgtcttgcattactattgtgcggctgcaggaggtgtcgagcggcgttatttttttt
gcggtttgccttttttttttctttttttttttttggaaccgcggttgtttaaaa
gcctgagggaacctggagaggggctcccactccctaccctctttcctccgagttt
gtgactccgagatg
```

*Homo sapiens* zinc finger CCCH-type containing 10 (ZC3H10):

(Seq ID No: 1036)
```
ggctctttgtcgaagctagaggaccggcaggcggcagcagcaactacggcggcggcgg
cagaacccagcagcgatgtggaggtggagaccccacaggagccccggacttcacctgagc
tacctcagtggtcaccaagagtggcaagataaagaaaaccctgagttgggcgggaccag
gatg
```

*Homo sapiens* poly (ADP-ribose) polymerase family, member 10 (PARP10):

(Seq ID No: 1037)
ccgtctttcagtttcacttttgttttcctgctcccagcagggttaggcttgctgaggggc
aggcacaggagtcctggctgagctcatggcctgaggctgcctagcggccacggggaatg

*Homo sapiens* RNA pseudouridylate synthase domain containing 4 (RPUSD4):

(Seq ID No: 1038)
ccgcccttccttgtaagatg

*Homo sapiens* family with sequence similarity 73, member B (FAM73B):

(Seq ID No: 1039)
ctgcccttccgcagcgatggcatcccgggtgag
tatcggccccggccgagcccccaaggcgggcgggcagcgcggcagggccgggactt
gagcggaggaccgagtaggcgcaggtgtccgggcccaacaggaccag
gaaggtgtcggggttggaatgagtgggtacccggccggggacggtgcga
gagggtgccttgcttgggagcggaacgagaaggtactt
gggtcagggaggtgatgcccgggcctggaacgtggcgggattggagcaggcgcg
caggtacccgatccgaggcggggagagcacccgggatggaaggag
caggcgtgcgggccgtgagcggcgccagagggtacctggctctgtg
gaggggccctctggtatgtgtgtccctgtccttctgggcgtggatggtgcctgg
gacccagctggcaaccagttgaagacgttctccttggaagctcttggccctgag
gactttgctggggcattggccctgccatg

*Homo sapiens* protein phosphatase 1, regulatory subunit 15B (PPP1R15B):

(Seq ID No: 1040)
gcgtctcttccggcgtctaggggggtgtcctgccggcgcgcgggccctgcggccattt
gggcttcgcttccaccgcaccagccggcctaccagtccttccggtatcgcgtt
gctcaggggcttttcaaccctctgtcagtcggaaaaccatcgccgaggccgtgggggg
gactcctatccatggtgttgaagcgtcgagccgactagggaacctccttccccgccag
gatgaagtcgcatcagtcgccgcc
tattgcgcgggctgttcttccctgtgttctgccgcccgctgccg
cattcgctgccctctgtggcttttctgctggctcgaagatcggcctggagcagcgac
gccaccgctgggcaaggccgagactctgtaggcttcctccgaatcccgtcgac
ctccagccgctgagcgccgcgccctacctgagagactgtcaagaaaaaggagatg

*Homo sapiens* family with sequence similarity 104, member A (FAM104A):

(Seq ID No: 1041)
ccctctcttcgcggagcggcgccgcgtagcttccatccgccagctgc
catg

*Homo sapiens* PRP38 pre-mRNA processing factor 38 (yeast) domain containing A (PRPF38A):

(Seq ID No: 1042)
agcccttttacactac
ggtgtttccggcttcaagatggtcgcctaagctgtttagtgaaacttcttccac
ctttctccattcctctaggtgcttttttctgaacctg
gatgtgaggcattaaaggatccgacggaaatagaattgaaggcattctaaaatg

*Homo sapiens* synaptotagmin-like 1 (SYTL1):

(Seq ID No: 1043)
cctcctccgtgtgggg
cagctgctggctgggctgcctgttgagtcagccttcttccctcac
ggctcttctcccggtccctgaaactcggctgccaggggagctggagccac
ctgcgaaggtgtcctcccatactggaccctacaggaagctccgtgtgcccagctgggg
cacagccccagctgatg

*Homo sapiens* ubiquitin associated and SH3 domain containing B (UBASH3B):

(Seq ID No: 1044)
gctccttttccttttgatccattcaaaaattactcatt
gcaaattcccggactgctaggcgaggagagggaagggggcggaggagacagggctactg
caggcgcagagctggggcagccgggggcccgagtggctgaggctggtcccg
cagcggccgcttgccggcgttctggctcctgtggcctcaccaggaagcgtcagag
tcccgacactggggaagctcg
gagcgccgcctccgctgccgccgcctcctgctggctctgggtcccgagccccctcccc
tggcccagcccgactccctcctccttcccgaac
catccggctcgggctccttccctggcgatggctggccgctgagccatg

*Homo sapiens* transmembrane protein 241 (TMEM241):

(Seq ID No: 1045)
ccgtctctgggcggctgctgccgctgccgctgctgctgctgcggggtcggcggcggcc
aggggatttgggcaggcaccgtggatccccgagaaggggacgagttgacagatg

*Homo sapiens* ataxia, cerebellar, Cayman type (ATCAY):

(Seq ID No: 1046)

gagcctctgccagccctgagctgggaagaagcagctacctcggaggcagggcgcg
caggcgggcggcgatgagaggggggcgcagccgcagccccgcgctggggagcccac
cgctaaccctgcaccccacccctgcacaaaagagctggcgggcgctggccac
gtcgccctgggtgaccttcctcggatgcagaatccgcccctgcgag
catcctcttcctcctaggctctgaaggccggggagcgtgagcgatgcccagctg
cacccgggcagggctcgccttttgtttgccagtaaggaggagaggctgtctcagctg
cagaggggtcatccctgcttcaagccagtgcctcttcccagctcccatg

*Homo sapiens* ELL associated factor 1 (EAF1):

(Seq ID No: 1047)

attcctctctcaccccacgcagaggagagaacttgcttctg
gacccgggtgggtgccggctcggctctccttgtcttccagagcggtggcccggaa
gcacagtcctcccagacgccagcgccagaagctcggatcgcggctgcaccggga
gagcgccgatctgggtgcgaggcaggtgcggggccatg

*Homo sapiens* tripartite motif containing 5 (TRIM5):

(Seq ID No: 1048)

gttcctctaggaaaattcctttgtgcagatcaggcccgtggattggtgag
tgaatcctaaccacgtcttccctggcctgtcttcactcttctccccagaatcaccac
ttctgcactggtgtctgaaggtgtattgagtgattttgtggagggcagaagtag
gaagtctttgggacaaaactgtatttaccttgggatctgtgaacaagaggaacctcag
cagccaggacaggcaggagcagtggaatagctactatg

*Homo sapiens* wingless-type MMTV integration site family, member 3A (WNT3A):

(Seq ID No: 1049)

cgccctctcgcgcggcgatg

*Homo sapiens* chromosome 16 open reading frame 45 (C16orf45):

(Seq ID No: 1050)

ctccctccctgcagcccgcaacgggaatggagtaaagggagacccgtcgacctggccac
ggggatcagcgatg

*Homo sapiens* zinc finger protein 502 (ZNF502):

(Seq ID No: 1051)

cattcttccggtttcagaagttaaggctggtgtcctggccccagtccacctctgggagcg
cctgcgccgctccgcggagagtccgtggatctcacagtgaaaaatgtttgctgacccttg
acattgacaaactgctgacagctcagatgatccatgattggaaggatgtggtcatcacca
agatgtctttctttctccggttcccagttttccagacctgaagtgttttccaatcaaa
gcgaagagacgatctgtggatg

*Homo sapiens* armadillo repeat containing 6 (ARMC6):

(Seq ID No: 1052)

ggctctcttgcgcaagcgcgctgtccgcttcttctgggcggacgctctg
gaggcaaaacatttccctgctgggggcggcgaccaccgtgagcgtcccggaaggggcgg
caaagacgcctccgtcgcgcacgaggtggcctcgttggctttaccttt
ggttcgcggtcgtccttggttatcgtgagcgtccgcgagtctctgggaggccaa
gcctaggggcgccacagcgcctgcgcgcgtacggcgggccggaagggggcta
gaggcggctccctgggtgacaaccgcgcgccccacctttccccacgtggccgcgaagacc
ggctcaggagcatctatcggctgcacgccaacatcaacacaggcgaagatg

*Homo sapiens* post-GPI attachment to proteins 3 (PGAP3):

(Seq ID No: 1053)

gctcctcccccggcggcgagccagggagaaaggatg

*Homo sapiens* histone cluster 3, H2a (HIST3H2A):

(Seq ID No: 1054)

tgccctctt
gtttttagtctcgcttttcggttgccgttgtcttttttccttgactcggaaatg

*Homo sapiens* ethanolaminephosphotransferase 1 (CDP-ethanolamine-specific) (EPT1):

(Seq ID No: 1055)

ggctctcctaccttctcggg
cagcccagtctttgccatcccttgcccagccggtgtggtgcttgtgtgtcacagcctt
gtagccgggagtcgctgccgagtgggcgctcagttttcgggtcgtcatg

*Homo sapiens* F-box and leucine-rich repeat protein 5 (FBXL5):

(Seq ID No: 1056)

ccgcctctgccccgcggcgagggtgtctatgga
gaggcggcggccgcggctgctgaggcggaggctgaggcag
tggcgatggcgcccttcctgaagaagtggacgtcttcaccgccccacactggcg
gatgaagcagctggtggggctctactgcgacaagctttctaaaac
caattttttccaacaacaacgatttccgtgctcttctgcagtctttgtatgc
tactttcaaggagttcaaaatgcatgagcagattgaaaatgaatacattattggttt
gcttcaacaacgcagccagaccatttataatgtacattctgacaataaactctccga
gatgcttagcctctttgaaaagggactgaagaatgttaagcctactactgttgactg -continued

```
gaagccttaccaataacataaaacaatcgaataacaattatttcatgtatta
tatgtaaaatatatatactggattcttacagtaagaatgaatatgaacag
ttaaattatgcaaaacaactgaaagagagattggaggcttttacaagagat
tttcttcctcacatg
```

*Homo sapiens* major histocompatibility complex, class II, DP alpha 1 (HLA-DPA1):

(Seq ID No: 1057)

```
ctgcctccactcggcctcagttcctcatcactgttcctgtgctcacagtcatcaattata
gaccccacaacatg
```

*Homo sapiens* secretory carrier membrane protein 1 (SCAMP1):

(Seq ID No: 1058)

```
tcgtctctctctctgcgcctgggtcgggtgggtgacgccgagagccagagagatg
```

*Homo sapiens* chromosome 15 open reading frame 57 (C15orf57):

(Seq ID No: 1059)

```
ccgcccctcccgatttcctccgggctacaggcgacagagctgagccaa
gcgtttactgggcagctgttacggtaagtgaggaggggctggggtgcccagcgtttt
ggatctcccactctggcccggcccggaataccacatagaggcctgggacctgat
tcatcccgtccagacagccctagagacctgagcgactgaggcctgggatctggacgccg
gaatttcctgcgtggttctggacgccctgcctgggctcagattccaaatg
```

*Homo sapiens* WD repeat and FYVE domain containing 2 (WDFY2):

(Seq ID No: 1060)

```
cctcctcttgtagtggcgccggcttgcatcccaggtcgtggcggttttggtgcctgaagc
agggagcgcggagtcgttcccgagagaggcggccaggctatgctcgccggtttccggcgt
tccgctccggccagccagagtctctgtctcaac
ctgtgtccgtgctccagcagtctcctcagcccggccccgcggcgcggtt
ggcggcggcgccccaggcgcgccccctcctccgatg
```

*Homo sapiens* topoisomerase (DNA) I, mitochondrial (TOP1MT):

(Seq ID No: 1061)

```
cgctcttcccggaggctggcagatg
```

*Homo sapiens* intraflagellar transport 122 homolog (*Chlamydomonas*) (IFT122):

(Seq ID No: 1062)

```
cttcccttcggacatgcgcgctcggagcaaggcgccctcg
cactcagcttaccgcgcatgtacgttgccaggggtaacgcaggtagccaaagtggctt
gtggagtggcgaccgttagtgaggcggttgctgagacagacgctgaggcgggtaggag
gagcccgagccgtaagggaagccgtgatg
```

*Homo sapiens* mitochondrial ribosomal protein L53 (MRPL53):

(Seq ID No: 1063)

```
agttcttccggggcggaggtcaccatg
```

*Homo sapiens* T-cell activation RhoGTPase activating protein (TAGAP):

(Seq ID No: 1064)

```
ccgccccttcgcttataatgcagagcatgtgaagggagac
cggctcggtctctctctctcccagtggactagaaggagcagagag
ttatgctgtttctcccattctttacagctcaccggatgtaaaagaactctggctaga
gaccctccaaggacagaggcacagccacacgggagtgaaatccaccccctggacag
tcagccgcaatactgatgaagctgagaagcagccacaatgcttcaaaaacactaaac
gccaataatatggagacactaatcgaatgtcaatcagagggtga
tatcaaggaacatcccctgttggcatcatgtgagagtgaagacagtattt
gccagctcattggacattctcactattctatgcctttaaaggcccttcaacggaaggga
tattcaggagagcagccaacgagaaagcccgtaaggagctgaaggag
gagctcaactctggggatgcggtggatctggagaggctccccgtgcac
ctcctcgctgtggtcttaaggacttcctcagaagtatccccggaagctactttcaa
gcgacctcttgaggagtggatg
```

*Homo sapiens* phosphoserine aminotransferase 1 (PSAT1):

(Seq ID No: 1065)

```
ggtcctccttggctgactcaccgccctggccgccgcaccatg
```

*Homo sapiens* CD97 molecule (CD97):

(Seq ID No: 1066)

```
cccctccttcataaagtcctggcctcgggacagcctgcacagctgcctagcctgtggag
acgggacagccctgtcccactcactctttcccctgccgctcctgccggcagctccaac
catg
```

*Homo sapiens* protein tyrosine phosphatase, non-receptor type 2 (PTPN2):

(Seq ID No: 1067)

```
cgctctccccggatcgtgcggggcctgagcctctccgccggcg
caggctctgctcgcgccagctcgctcccgcagccatg
```

-continued

*Homo sapiens* chromosome 20 open reading frame 112
(C20orf112):
(Seq ID No: 1068)
gcccctctcccgggcagccgcggcggcagcagcagcagcagctggagctgtggggc
tgtcaccgccgcccgcccgctcactcgcggatcccgaccgccatctccgcctcgcttc
cagcccaggatgagacttctgtgagcagcgaggattttgatatg

*Homo sapiens* APEX nuclease (multifunctional
DNA repair enzyme) 1 (APEX1):
(Seq ID No: 1069)
caccctctttgtgctcgggttag
gaggagctaggctgccatcgggccggtgcagatacggggttgctcttttgctcataa
gaggggcttcgctggcagtctgaacggcaagcttgagtcaggacccttaattaa
gatcctcaattggctggagggcagatctcgcgagtagggcaacgcggtaaaaa
tattgcttcggtgggtgacgcggtacagctgcccaagggcgttcgtaacgggaatg

*Homo sapiens* intermediate filament family orphan 1 (IFFO1):
(Seq ID No: 1070)
tttcctcttgagccatcatgcacatctgactgcagcccagcgagcccttccttcctt
gtctgactgctcttcttctcgatttcttcttgttctgccttctcggttt
gcagccctgaccccgctgtgtgtctggccctt
ggtgactgtccgtgtttctgttcctgtcatt
gtaactgtgactttctctctgtctgcccccttcc
tactggttcatgcttctcccccattcccaccctctctgcccggcctcccgctcccgccct
ttctcctcatgcacccggcctcgtctctgtagtctctgcactt
gtctcccattaaggtcccatccatg

*Homo sapiens* neuralized homolog 2 (*Drosophila*) (NEURL2):
(Seq ID No: 1071)
cagtcttcctcccgccccttctttggtccctacggac
ctgggggcggtggcggtcaatgccgggtcaaggtccgcgggcctcgcagatcg
tagcccgggcgcacgcgatcagatgatcctgttgtggacggctaagttgtaggcgg
gatggctgagaaagcggcgctaggaccccgggcagaggctcggggaagggag
tcagggggaaatgccttacaaggtcgccttgcggtcaccatcatt
gcccgccgccaaaatagccccggcgccagctggcctgccctatggccgagagatg

*Homo sapiens* drebrin 1 (DBN1):
(Seq ID No: 1072)
ctccctctttccctcctcctccgtccgcccgtccgtccgcgcgtctgtccgttcgg
cccggtccggcccgaagcatg

*Homo sapiens* WW domain containing adaptor with coiled-coil
(WAC):
(Seq ID No: 1073)
cagcctcccttatttagtccgcgatggcttccctcgcgcccaccgtcctcttccggaag
gcggctccctccctgcgcagcccggagcccctgagatcagcctcgagcaggcgcccgagc
gagactatccctaaacgggaacggcggtggccgactcgcgagtgaggaaaagaaggaaag
ggcagactggtcgcgaagagaagatccaggcctcagaggaggagaaaggccggagccagc
cgaggtttgccgagggcggtgttccggacccgcgcggtgcggggaggaaggccgagggtg
ggagaggaggggcccggcggaaactgccgaggtttcccgaaggcggcagcgtccgagttg
cccggatgtagttggtggagcggcagcggcggcaccagcggcggcggcggcggcggggagg
aggaggaggagaagaaggaccaggcggcggcagcagcggcggcggcggggggaggagggg
aggaggcggcggagcaggaggaggagaaggcggaggaggcagtcgctctccgcggggctg
agccggacgcgtcgtcttgccccctcccccggttcgcggtgccgccgtgtagttggcg
ccgctgccccggctgagagtgagcgtggtgtcgacggagggagatggccgggagcgccg
gcgccagtaactgggagctgatgagagtcgccgagggcgcgccgggcccaggtgccgggg
ctgcccgccgccgccgccgccgccgcctgcgcgcccgcccgcctttcgcggccgctctc
ccccctcccgacacacactcacaggccgggcattgatg

*Homo sapiens* kelch-like 6 (*Drosophila*) (KLHL6):
(Seq ID No: 1074)
cgctccttcag
tctcgatg

*Homo sapiens* GTPase, IMAP family member 1 (GIMAP1):
(Seq ID No: 1075)
cagccttctgcactcacagccgaagggaaagcagcaggttggggcttctt
gtggccaacttcagagcctgtcaccaggaaaggtaagcatg

*Homo sapiens* RAB24, member RAS oncogene family (RAB24):
(Seq ID No: 1076)
cgccctctagcccctcccgcgggagtcgcggcgctgcgggtaggagccgggttgcgg
gagaccccaggttcggttgggattcccagccagaacggagcttaagccggg
caggcgagcgaatgacggagtagcgagctgcacggcggcgtgctgcgctgttgaggac
gctgtccgcgcgctcccaggccgccccgaggcttgggtcttcgaagga
taatcggcgcccggggccgaacagcggggcacacgggcgctgccgaagtg
caaggccacggccagagctcgagcccgacgcgctgtctggagtcgtaggaccctgac
gtggctgaagcggcccgggagcatg -continued

*Homo sapiens* adaptor-related protein complex 2, alpha 1 subunit (AP2A1):

(Seq ID No: 1077)

agccctccccgcggccggctcggctcctt
ggcgctgcctggggtcctttccgcccggtccccgctt
gccagccccgctgctctgtgccctgtccggccaggcctggagccgacaccaccgccat
catg

*Homo sapiens* copine IV (CPNE4):

(Seq ID No: 1078)

ctccctcttttctcag
tacccctcctcttttactctccgagttaactgagagccgac
ctgacatctccaacattttcaccctcttcccccaccccccatcaccgagaatggag
tcagggtttccggagagaccgaactctgctctcagcacctttcccagccgctgtt
gctaaactgacctcggaggacgagaggggaaggaggtgcgacgccccttacatcag
tacataactaccacaccaaccacctccacttcaaagccggattttt
gcatcctgggggcgggacagacctcgtcccgggctgaattctctctccactcttcga
gattggcacacccagaatg

*Homo sapiens* synaptosomal-associated protein, 25 kDa (SNAP25):

(Seq ID No: 1079)

ctgtctttccttccctccctgctcggcggctccaccacagttgcaacctgcagaggcccg
gagaacacaaccctcccgagaagcccaggtccagagccaaacccgtcactgaccccccag
cccaggcgcccagccactccccaccgctaccatg

*Homo sapiens* cAMP responsive element binding protein 3-like 4 (CREB3L4):

(Seq ID No: 1080)

aggtctcttgactctttccgcctttt
gtttacaaccctgccatgatctccctcttgcaaaagcgagggc
tacagaacaggcattcaggagtcctgtgctccag
tcacagccttttctgttcttcagctaggagacaccaaaccctcaggaagatttacta
tagctaagagaaaactgcagcagaaagggcgcggctacctacttcttaaattccgttt
gtggaccctcagactcttagtcccctactcccagatacagcggccctac
cgtggctcctggcaaggtggcatccacttttgtagtaagcatg

*Homo sapiens* leucine-rich pentatricopeptide repeat containing (LRPPRC):

(Seq ID No: 1081)

ctgtccttctggcggagcgtgcttcccgctgcggggacgttcgagcaatg

*Homo sapiens* zinc finger protein 418 (ZNF418):

(Seq ID No: 1082)

cgttctctgg
tagcgaccattttggttaatgttgggtgtgtttctgcggtttgtgaggtga
gaggcgctggagctatgggtccgaaccgcggtgtctgaacccagaaggtgaagag
tccttcttgctgcacagaggcagatcttaggcccccgtaacggcgcccgccgctcccgg
cagtgctttccccgcgtactcgg
gatggcggcggccgcgctgaggctcccggctcaggcatcatctggctgcaaagaaga
gaacacactgtgtttgagggaggaggaaggaggatcagagtttaaactcctgccataatg

*Homo sapiens* tetratricopeptide repeat domain 14 (TTC14):

(Seq ID No: 1083)

gtttcttccgcttcctgtaccacccggctcaagtagcggacacggaacagggaac
tatcagcccgtcggcctccgggccctgcattctctagccatg

*Homo sapiens* BMP binding endothelial regulator (BMPER):

(Seq ID No: 1084)

agccttttcgactgtgagctgcggcagctgagcagaggcggcggcgcgggacctgcag
tcgccagggattccctccaggtgacgatg

*Homo sapiens* zinc finger protein 384 (ZNF384):

(Seq ID No: 1085)

ccccttttcgtttccggcgctcccgccttctctccgcagagctcttctctgagcctgtt
gggggagggaggggggcgtggaggaactgggggttcgcgggagcacgagctgcagcacca
cttccgggtgagtgcaaggggagggcagcaaggaggggggccaccactacctcgcgcc
cccgccctgcgggtgtctcgcgcgcgttccgtgcgtgtgagtgtgtgggtctgtctcgct
ccagaagtgcgtgcccgcgcgctgcgccttgcgcttttttcccctccctcgcccttcctg
gtcctcccaccctcctcggctccctccttcccagcaaacgccgccctcccgcgccctg
gctcaggctctggcgccgccgcagccgtcgccgcccgaaagttcaggagccctggaaagg
agaaggaataagacggcaggaggaagagagagagagggtagaatg

*Homo sapiens* RAD51-like 3 (S. cerevisiae) (RAD51L3):

(Seq ID No: 1086)

ctctcctttctcctccggcagccagcgcgcctgtgtcctctctaggaaggggtaggggag
gggcgtctggagaggaccccccgcgaatgcccacgtgacgtgcag
tcccctggggctgttccggcctgcggggaacatg -continued

*Homo sapiens* CD99 molecule-like 2 (CD99L2):

(Seq ID No: 1087)

gctcctcctcccgctcctcctcggcctcccctttcgggcgctctcgcgctaactgtgctcc
tccggggccctccgcctgctcccagccatg

*Homo sapiens* glucosamine-6-phosphate deaminase 2 (GNPDA2):

(Seq ID No: 1088)

gcgcctttatctgcatccgggtccgtgggattcgcgctccac
tggtcagctggggtcgctctcgggtggttgggtgttgctt
gttcccgctgttccagcgtcgaagaaccattgggtctgccggtttgaacttgttctg
gaagctgtgcgtcaccgtaatg

*Homo sapiens* methionyl-tRNA synthetase 2, mitochondrial
(MARS2):

(Seq ID No: 1089)

ccgcctcctccgcttgcggccggtctgcaccatg

*Homo sapiens* chromosome 12 open reading frame 57 (C12orf57):

(Seq ID No: 1090)

tttcctttccgctcccaggggcgttgggaacggttgtaggac
gtggctctttattcgtgagttttccatttacctccgctgaacctagagcttcagac
gccctatg

*Homo sapiens* tRNA-yW synthesizing protein 3 homolog
(*S. cerevisiae*) (TYW3):

(Seq ID No: 1091)

ggacctttcggccaccgctcgcttcaa
tatggctgccccaggagagacgaggctaccatgaaggagccgagcgcagaccctgag
tccgtcacccatg

*Homo sapiens* Sp1 transcription factor (SP1):

(Seq ID No: 1092)

ctccctcctcctttaccccccctccctgtccggtccgggttcgctt
gcctcgtcagcgtccgcgtttttcccggccccccccaaccccccccggacag
gaccccccttgagcttgtccctcagctgccaccatg

*Homo sapiens* histidine triad nucleotide binding protein 3
(HINT3):

(Seq ID No: 1093)

cgccctctagtggcagccggttttgaggccggcctccggctttt
gaagttcctcaccgcgtctccttccctctccccaaagcctggatcac
cgcccagcgtcaggcgaggggcgacgtctcgaggtaaaacggaggaggtgcgggacgcg
gagactgcgcgggcccggtagccctgga
gaggccgaggctctaggccgcgaggggcgggtgcaatg

*Homo sapiens* M-phase specific PLK1 interacting protein
(MPLKIP):

(Seq ID No: 1094)

agttctctgcggagggccggttgatacagttccggtgggagaac
gcggctgcgaggttttcggctttggctcctgatatg

*Homo sapiens* palmitoyl-protein thioesterase 2 (PPT2):

(Seq ID No: 1095)

caccccttcccccgccaccgtgggttccagacttgggataagtaaacagcgggtggagcg
aggcctacggacccaggccaggtgggagtctgcactcttcaaggggcctgggctgctgct
cacgggtattaaagaactccgcgttgttcatggctgaggcgatgcattaggaagatcctg
gacctagagaacaagtcccccgaacgctgagttggaggcgggacttcgggtgcgcgttgg
cgggagcatg

*Homo sapiens* BCL2-like 14 (apoptosis facilitator) (BCL2L14):

(Seq ID No: 1096)

aagcctcttttcaggctgagtcctaaacctgaagaaagttta
gagcctggggctctaaactacctgagtcttttccaaacgacaagccaagaagacctgtt
gaaagtttcctcttaagtttcgtggagagagactcaggtatagaaa
tatccttactgccacctgacctgaagcagaagaaatcacagacagcttccagac
caggcccaacatg

*Homo sapiens* galactose mutarotase (aldose 1-epimerase)
(GALM):

(Seq ID No: 1097)

acgccccttctcctgtaaacttgggtcgcctctagcttagcgagcgctg
gagtttgaagagcgggcagtggctgcacacgccaaactttccctatg

*Homo sapiens* carboxymethylenebutenolidase homolog (*Pseudomonas*)
(CMBL):

(Seq ID No: 1098)

cttccttcccttccccgactttgcagat
ttctcttcccccaggcctccctcctccacctctccgcccctccgggctt
ggctctcccaggaggctacgactggagccactggtcccgcag
gatccccgcgtcctcggtgccgcgtccacgtccctctcgcgtccccgcccggcgccac -continued

```
gccgcctcctctgggttcggcctccgcgcggtgcagcgcagtctcaggccgcgggacaa
gcccgacttaaatctctgcaatg
```

*Homo sapiens* chromosome 7 open reading frame 31 (C7orf31):

(Seq ID No: 1099)
```
cgtccttctcccgcccccgccctgcctgccagctccaccgggccgtaggtgcggac
gacctcaaaattcctcggcccgcgaaggccgccagctgcggggaggggaggg
gaggcgcggtcccg
cagcgcccccaggctcatgtcccaggtatgtccagacccccgaggcaccgcttgcaggg
cagtgacagcccgtgaggcctcggcctcgaccctggcacccttggtcccagctac
gccggctcctggccttcccccaagtccgagagagaggtgggattctccccgacgcagtt
ggaaaccgggaatcccctttagggtcccgttcgtgctgcactactgactccaccatctg
caaagggattcttgtccagaatccccgaaggcttaggacagcgcttattttgtt
gaatgaagagtctctaattttcggaaagaccacaggctaaaagtcaagtt
gtgccttttagccaagaagcatg
```

*Homo sapiens* secretory carrier membrane protein 5 (SCAMP5):

(Seq ID No: 1100)
```
cggcctttcggcagccgaacggccgcggcagttcaggacaaagaggtgtggg
caggccactgggccagctggtaacatcatg
```

*Homo sapiens* mitogen-activated protein kinase 10 (MAPK10):

(Seq ID No: 1101)
```
tgctcctttcggttgccatagcaaccccattccccaagccctctgtccgtctcctctggt
aggttccacaatggtacaggcagcatcacgctgcacaatggtttccaggcagtgaaagag
ggtgattcagcaagccactcttcttctattttctttaacctccccttcacttttattt
tatggggtgggtggtgcttgctatatgcttacctttttcttttcttttttcattttac
aaatttcctttttgtcctcacccctcaattcctaggggcttgagtgagtttaagattgg
gttttcttggaaatcacctgtccatcgttaattttaaacaatctccatatctccaaagaa
tctcttccatgttagtctggaatgtggttaatgaaaaacaagtagggaggattctgggg
caaacactgccggatcaggatcgtagttctcaggcacggaatggctagtgtgagaaacac
caacagcaggcccatctcagatcttcactatggcaacttatgcaagaaactgttgaatta
gacccgtttcctatagatgagaaaccatacaagctgtggtatttatgagcctccatttct
tatactactgcagtgaaccaacattggatgtgaaaattgcctttgtcaggtgtgttc
cttacaggtaaaacaagggattcgataaacaagtggatgtgtcatatattgccaaacatt
acaacatg
```

*Homo sapiens* beta-site APP-cleaving enzyme 2 (BACE2):

(Seq ID No: 1102)
```
cgtcctccccgccgccgcggtcccggtgcgcgcccatccctgcccg
cagccccgcgccggccgagtcgctgagccgcggctgccggacgggacgggac
cggctaggctgggcgcgccccccgggccccgccgtgggcatg
```

*Homo sapiens* SWI/SNF related, matrix associated, actin dependent regulator of chromatin, subfamily d, member 1 (SMARCD1):

(Seq ID No: 1103)
```
acgccttttccgctagtcgccccgctctatccca
tagtctcgctgccctgagcctcccgtgccggccggccggccgggg
gaacaggcgggcgctcgggggggcgctcgggggggcgggggag
ttccggttccggttcctttgtgcggctgcatcggcggctccgggaagatg
```

*Homo sapiens* family with sequence similarity 175, member A (FAM175A):

(Seq ID No: 1104)
```
cgtcctcttgtgtagcctgaggcggcggtagcatg
```

*Homo sapiens* adenosine deaminase domain containing 1 (testis-specific) (ADAD1):

(Seq ID No: 1105)
```
aggcctcttttgaaa
gatgcggccctgaccctgtgaacctcgcgcagagcggcctgaagcgagaggtt
gaggctgggaggtgagaaaatg
```

*Homo sapiens* acyl-CoA synthetase short-chain family member 2 (ACSS2):

(Seq ID No: 1106)
```
gccccctctacggaggccccgcctctagttcggcctgttttctcag
tcccggcacccgccgcgaccgcaaaggcggccgcggttctaggaacttgacgtgatg
```

*Homo sapiens* multiple coagulation factor deficiency 2 (MCFD2):

(Seq ID No: 1107)
```
cttcccttactcaccggtgtccggaaaggtgaac
gctgcgctcgggctgcctcgcctgttacctccgccgccgggcatg
```

*Homo sapiens* SPOC domain containing 1 (SPOCD1):

(Seq ID No: 1108)
```
gctccttttcagctagtgggtggaaccccaggagggaaaactcagggaa
gcccaggccccgtgttgtgctttggcccaggtaggtggacagacatg
```

-continued

*Homo sapiens* LY6/PLAUR domain containing 1 (LYPD1):

(Seq ID No: 1109)
agttccttcagtctcagccgccaactccggaggcgcggtgctcggcccgggagcgcgagc
gggaggagcagagaccgcagccgggagcccgagcgcgggcgatgcaggctccgcgagcg
gcacctgcggctcctctaagctacgaccgtcgtctccgcggcagcagcgcgggccccgag
agcctcggcagccacagccgctgcagccggggcagcctccgctgctgtcgcctcctctga
tgcgcttgccctctccggccccgggactccgggagaatg

*Homo sapiens* cytochrome b5 domain containing 1 (CYB5D1):

(Seq ID No: 1110)
cattctttcatactgcctcctcccttgtttttctgtctcagagaga
tagtctgtcctaaatatcccatgtagcccaggccactgaattaaaacggagcg
tattcgttctctgccccaccccgcaactcctgaaagcggcgcaactcaattactt
gatccttatatgccccacgcgggactcatactacgtttcccgtgaacacgtgcag
tccaaaccccgcccctgatatttatctcagtggacggtggccg
gaaaaggacaatggtttccatgtcagcggataaacgctctcccctcggctcccggac
gcgacggaggtcgtagtagtagtgagtacgtgctgaggagcaaaggagtaaccaaga
gatccagtgaccgacagagcaagagccatg

*Homo sapiens* synaptoporin (SYNPR):

(Seq ID No: 1111)
tctcctcctttgcttcataaaaa
gagggacaagtggctggtgctgtggacagagaagctttattttagtatgagacaac
ctctattttctttcaggagagggaagttggattatcaattcttttgtaaatg

*Homo sapiens* heterogeneous nuclear ribonucleoprotein U-like 1 (HNRPUL1):

(Seq ID No: 1112)
ccccccctttcccccttcgcctcctgacaggaaaggtttaagggg
gacagagccctgggaggccgggccgggctcggggccaccccgggggcccgggccatg

*Homo sapiens* schlafen family member 5 (SLFN5):

(Seq ID No: 1113)
ggttctctgctctggacttgggaggctccgttgcctgctcccggagggagac
gcgctgccgaggagaacccagcgggagaacatttcaggataggaa
taggccaagtgctgagaagatg

*Homo sapiens* MAS-related GPR, member F (MRGPRF):

(Seq ID No: 1114)
ccatctcttccagcaggagagggctctactctgagctcc
tattttccaaggctccgggccgcgctcggcgctggcctgctgccccggcgggtccgccgg
ccggaggcgggagtcacaggaagagccctccacaaaaggaggcctcggcggatcag
gacagctgcaggtgggtgtgcagactggtgagctgccagcaggggcccagac
gcgccaggcctggagatg

*Homo sapiens* ubiquitin-like domain containing CTD phosphatase 1 (UBLCP1):

(Seq ID No: 1115)
cggtctctcagcggccggtttctgcgtccgctgccgcaggttccac
cgcgctccaggtattttttttttctgaaggaaagctgcttcctcatatgtttcaagaatg

*Homo sapiens* Rab interacting lysosomal protein-like 2 (RILPL2):

(Seq ID No: 1116)
cctccttttccgttgtcccttcgcgccccaaaccacatcctggagcg
cactctccagcgtggctggcagcggggacggtgcgccggggcgcaggcccaagag
tcgcgtgcgcggccccttgcaccatcccccccgggccaccccgggccgcgctgattggg
caggtagggactctgcccagcggaaagttttgggtgccgggaggaagtctaacctttgg
gagactccaagacagcagctccgaggtcggcgggggtctgggtggccatg

*Homo sapiens* zinc finger with UFM1-specific peptidase domain (ZUFSP):

(Seq ID No: 1117)
acttctttcccgtgggagtaaggaagtgcttttgaatgaggtactgagggcaaggtgtt
ggaagttcctaattctttcctcggttaactgtgaaactctgcgtattgggaaggcctggc
ctcagtcatcaggccaggagaggtactggacgccgcgcacgcactcgtctgccagcgagg
cccaaaggggaagcctagcggagctcagtgtggcagctgctggcctctgggccgctactt
gtcaataccatg

*Homo sapiens* mitogen-activated protein kinase kinase 5 (MAP2K5):

(Seq ID No: 1118)
ccgccttcctcctcctcctctcgccgctaccgccgtcgccgccgccg
cagccgccgccggtccgcgcggcctcgggtggccg
gagctcagcctgcgcgcgccgcgccctgtgtctccgggtggggcagaa
gactcgccccttgaacctcccgcggggactctccgtggtgttggcggccctgggctcttt
cttaatagcccccggactgagtcccctccagtcgaggaccctctcctagtccactgacgag
cggtggacacctgccgctgtatctccccccaaaccgagtccttgccctgctgcctcctcat
acccacacggcggcagagaccttcaccatagcgttcgctcaactccagaaccttccgacc
tccgctagttcctgcgggcctttgcccgcttcccggtgcaccctccccgggagacacctc -continued
agaccccgacagcctgggcaggctcggtgcctgcgggtgcgttcctgatcaccctccc
ctcttccctcccctcatcctccattcccttgttttcaccctctgtcctctgcccgtcac
tccccttgtcacctcttggagcccctcctaaccagcggccagtgggtttcccataccc
aggatgtgagcctcttaacctgtaatg

*Homo sapiens* solute carrier family 2 (facilitated
glucose transporter), member 12 (SLC2A12):

(Seq ID No: 1119)
cactcttctttag
catgctattatggggaaagtgaccactcctgggagcgggggtggtcggggcggttt
ggtggcggggaagcggctgtaacttctacgtgaccatg

*Homo sapiens* mitochondrial ribosomal protein L30 (MRPL30):

(Seq ID No: 1120)
cttcctctgctctgcttcccttcggag
gaaaatttcaggctgaaggtttagcgggtgccgcctctaaagagagcaatcactacact
tatg

*Homo sapiens* tripartite motif containing 11 (TRIM11):

(Seq ID No: 1121)
gctcctcttcctgccggcatccgggatccctacgtcccgcgtcccccgagcgctcg
gagcctacgcgcccagcgctaccgaaacccagagtcctgcgcctggag
tccccgcgccccggagcccgagcaccgggagtcccgagcctcgcgccccggag
tgcccgagcctgcgccgccgcacccgga
taccccgcgtccccgcgagctgccgaggccgcccgccgccgccccgcggacagtac
cgccttcctcccctctgtccgcgccatg

*Homo sapiens* proline-rich transmembrane protein 2 (PRRT2):

(Seq ID No: 1122)
ctccctccctagctgacttgctccctcccggctgcggctgctgcaaaagccagcagcgg
cagcgggagctgtccggaggccggcgtcgaggggtttgccgctgtctctgctattccatcc
tcccatagggctctctcccctctcccatctcaagatg

*Homo sapiens* zinc finger protein 626 (ZNF626):

(Seq ID No: 1123)
cggcctttgtctctcgctgcagtcagagctccaggtctggttcttctcctaaaggcccag
gctgtgtggccccgtgtcctgcaggtattgggagatccacagctaagacaccgggacctc
ctggaagccaaaaatg

*Homo sapiens* solute carrier family 25, member 43 (SLC25A43):

(Seq ID No: 1124)
cggtcttccgggcccgggtcggggctcgatg

*Homo sapiens* crystallin, zeta (quinone reductase)-like 1
(CRYZL1):

(Seq ID No: 1125)
ggctctctgacgaaggactggaaggtggcggtggtgaaggtg
caggccgttggggcggctcagaggcaggtgactatg

*Homo sapiens* mitogen-activated protein kinase kinase kinase
7 (MAP3K7):

(Seq ID No: 1126)
ctgcctctaccccgccacggatcgccgggtagtaggactgcgcggctccaggctgaggg
tcggtccggaggcgggtgggcgcgggtctcacccggattgtccgggtggcaccgttcccg
gccccaccgggcgccgcgagggatcatg

*Homo sapiens* septin 6 (SEPT6):

(Seq ID No: 1127)
cttctctttgtcggag
gagctcctctgtttcctgtgcagtagctcccgttgcggcggcacccgtgg
cagccctggcggacgcaggagcgatg

*Homo sapiens* myotrophin (MTPN):

(Seq ID No: 1128)
ctgcctctcctcggccaggcggaac
ctctctgctgggcccggtggccgcaaaagaactttctttctcccgccccgaac
ggtcgccgcggccaactgcctcgcccgcctgg
cagcctaaccctccttctcttcttctcctctccggcttcgcgcggccctgcctccctc
gcccggcggcatccgcttgctgctgccaccgcctcctcatcttctgcccggccaac
cggcctgccccgctgcagtgatg

*Homo sapiens* annexin A11 (ANXA11):

(Seq ID No: 1129)
ccctcccttgcactgcctctgg
cacctggggcagccgcgcccgcggagttttccgcccggcgctgac
ggctgctgcgcccgcggctccccagtgccccgagtgccccgcgggccccgcgagcgg
gagtgggaccccagccctaggcagaaccaggcgccgcgcccgggacgcccgcggaga
gagccactcccgccacgtcccatttcgcccctcgcgtccggag
tccccgtggccagggattattggacctgcctggtttaaactattgtcttagttaatttt
gtgctgctctaacaaaatatcacagactgagtaatttataagcaatagtagcttattt
ggctcacagttctggaggctgagaagatcgtgaggctgcatctggcaagggccttctt -continued gctgcttcataacatggcagaagacatcatgcgggtgtgtgtctggggaaga
gacttacagaagtggagttgctgagtcaaagatctaaccatg

*Homo sapiens* RNA binding protein, fox-1 homolog
(*C. elegans*) 1 (RBFOX1):

(Seq ID No: 1130)

tttctttctttcctctcccggcgttgatgag
tgcttggctcctgacagaagggatttggctcccagctttgtagttcggaagaagtt
gggtctatagatttcccctaactctccattgatgtgttgagcttcagagggaataa
taactctacgtaaagcatg

*Homo sapiens* prefoldin subunit 5 (PFDN5):

(Seq ID No: 1131)

cttcctcttcgttaagtcggccttcccaacatg

*Homo sapiens* high mobility group AT-hook 1 (HMGA1):

(Seq ID No: 1132)

cgctcttttaagctcccctgagccggtgctgcgctcctctaatttgggactccgagccgg
ggctatttctggcgctggcgcggctccaagaaggcatccgcatttgctaccagcggcggc
cgcggcggagccaggccggtcctcagcgcccagcac
cgccgctcccggcaacccggagcgcgcaccgcaggccggcggccgagctcgcg
catcccagccatcactcttccacctgctccttagagaagggaagatg

*Homo sapiens* zinc finger protein 323 (ZNF323):

(Seq ID No: 1133)

cggcctttt
gcggttgatcggtcattggggtgctgcagccccgccacctgttccgtagctt
gccggtgccccgaaggtgtcttctcctaaggaagat
taaatcagaaaattttaaatcacagttatcccttacttaaagccagagtaa
gccttccaaattaaccccaggaatg

*Homo sapiens* tumor protein p53 inducible protein 3 (TP53I3):

(Seq ID No: 1134)

cttctcttctcttagcagcacccagcttgcccacccatgctcaagatgggcgggatgcc
agcctgttacataaatgtgccaaaagcctggccatgcctggaaaatggaccaatccgccc
gccaagaggtttgggtctcgttccctagaga
gaaggaagtttcctctccttgaagtgagagctagaatcgcactttctgtcaagctgaga
gaaagactcttttccagaggctaaaaggacaagaaaatctgatttgctt
gcttctaactttgcgttttaaagggggaaggaggaaaggaaagagggg
gagggtggttctgcttagccccaccctccggc
taccccaggtccagccgtccattccggtggaggcagaggcag
tcctggggctctggggctcgggctttgtcaccggacccgcaggagccagaaccac
tcggcgccgcctggtgcatgggaggggagccgggccaggaacaatatg

*Homo sapiens* ceramide synthase 5 (CERS5):

(Seq ID No: 1135)

ccgcctccccgcgggttccgttggctgtggcggcagctgacgctt
gtggcggcggtggcttcggggtgggcgtaagatg

*Homo sapiens* TRAF3 interacting protein 2 (TRAF3IP2):

(Seq ID No: 1136)

tgttcttctacttacctgggcccggagaaggtggagggagacgagaagccgccga
gagccgactaccctccgggcccagtctgtctgtccgtggtggatctaagaaactagaatg

*Homo sapiens* Smith-Magenis syndrome chromosome region, candidate 7
(SMCR7):

(Seq ID No: 1137)

ggtccttcac
gttccattcccaggctggtctgagctccggggccgtggtcccgctgcctcctccggtcgt
cgtgcggaagctgcgacgcaggcagaccatg

*Homo sapiens* mitochondrial ribosomal protein L10 (MRPL10):

(Seq ID No: 1138)

cattcttccggtggagatggctgcggccgtggcggg
gatgctgcgaggggtctcctgccccaggcgggctagagtgcagtggcatg

*Homo sapiens* proteasome (prosome,
macropain) subunit, alpha type, 1 (PSMA1):

(Seq ID No: 1139)

acttctctgtagatcgctgagcgatactttcggcagcacctccttgattctcagttttgc
tggaggccgcaaccaggcccgcgccgccaccatg

*Homo sapiens* sorting nexin 5 (SNX5):

(Seq ID No: 1140)

cggtctttctctagac
gcgtcttgctgggagagtgtccgttgcttcccgtccgtgtcgcggccctgcggtt
ggcggcctcctcgtggagcggagcaaggccaggcggcccctgctcgagtcccgcgtcgc
catg -continued

*Homo sapiens* zinc finger protein 276 (ZNF276):

(Seq ID No: 1141)

```
gggcccctccgcgcgtactgcgggcccacgggtgttagtggcggggcggcagagtcc
gggtgggttgtcgcgacggagccgggcctcttcgccgtcttgagacggggctggcgagaa
gggccctcacggagttgccatgggcgtctaaccgcggcagccaggccccctctctacgtg
agacccggcccccctcccctttctgcagcccgcccgccacctgcgcgccgcgtggcctc
cgccggcgcctgcccgccccgcgcctccgtctcccacggagcaggccgggctctcgc
catg
```

*Homo sapiens* zinc finger protein 561 (ZNF561):

(Seq ID No: 1142)

```
ccatcttttccggcgctggctcctctccgtcagtgcggtttcgcctttatggtggtg
gagtctgcccaggctgtggaccgcaaataaccctgtacaaagaggaatgga
gattgcctctatccacctagattcataagctggcctgaggtgatcttgg
catcaaggaagggatgcacatcatcacaccatcagcttcagagaatg
```

*Homo sapiens* mucin 7, secreted (MUC7):

(Seq ID No: 1143)

```
ctttctcttctttt
gcttctagttaccatcctcaaaggattggctaaaagcaagcaactg
gattgaaaccctaagaagaaagattcacactgcaccaggagacatcagaaagaatg
```

*Homo sapiens* threonyl-tRNA synthetase (TARS):

(Seq ID No: 1144)

```
gcgcctttcgattgcatcagctggtccagccgaggccaagtcccgggcgctagcccac
ctcccacccgcctctt
ggctcctctcctctaggccgtcgctttcggggttctctcatcgcttcgtcgttcgccaatg
```

*Homo sapiens* ATPase, Na+/K+ transporting, alpha 3 polypeptide
(ATP1A3):

(Seq ID No: 1145)

```
cagcctctgtgcggtgggaccaacggacggacggacggacgcgcgcac
ctaccgaggcgcgggcgctgcagaggctcccagcccaa
gcctgagcctgagcccgccccgaggtccccgccccgcccgcctggctctctcgccgcg
gagccgccaagatg
```

*Homo sapiens* chromosome 11 open reading frame 46 (C11orf46):

(Seq ID No: 1146)

```
cgtcctctcagtggtagcgcggggactggctgggaagcggtcggtcgag
tgtggcctgtgtggactcgcatcttgcccgaagccgggcggaggagagctcaa
gctaagggtgatcagcccatgacctaaacctccagacaaaataaaacggaaaattt
gctagaatcaagaatg
```

*Homo sapiens* chromosome 17 open reading frame 45 (C17orf45):

(Seq ID No: 1147)

```
tgaccttttcattcccgttgttatggaggtaggctctctaggaatctgggagtagtagct
gggggggcaagagcaaataaagagctcgagcttctgtggtctctggggagatg
```

*Homo sapiens* AHA1, activator of heat shock 90 kDa protein ATPase
homolog 2 (yeast) (AHSA2):

(Seq ID No: 1148)

```
gggccttctggcagtttctgg
gagctgcgaacgcgccgccccggggctcggcggccggaaacgctggcttcg
gagccttaggcgccgcggccctttccttgttttccgcccagtccac
gccgccatggccaagtggggcaggggaaccccccactggatcgtggaggagcgggag
gacgggaccaacgtgaacaactggcgctggcgcggctggcggcggcctccttccgg
gatctggggagggccgggccgcgg
gagccggggctgccctgggtctgtgcggggccgcggggccaggggtcaggggccgcc
cccctcagctgctggacgcagggctcggcctccgcctctcggctcgggagagtcctt
gagtacggagaccggctaggagggttgcagctgcctcttttgaaagttgggtt
gggccccaagagtgacttccgacagacctttccactcccac
cgtctgtggcctgagggccttcccttctcctcccgcccaccctctggatgtttcggg
gagttagaagggagctggattgagagactgtgttaggggcggggtatggaacgtagtg
gaaagggcagaaatttggatctcagttcgcgcccaccccg
caggcgcctcccgcgagccgggccctctgtgagtgagacaagctccccttccttttac
gcgcctcacctggcgcgtggggagaggtcggcagccctccgccgcagaacctccg
gaagggatgtcctctgccctgcgcctctgccggggctgtggtccctccaggccgtcgag
gggatgctgaggccggtccccagaggagcatgacttggctggtccggag
gagctctgagggcatgggcaatcttggctcgctgcaacctcagcttccagagttcaa
gcgagtctcctgcttcagcctcatgagtagctgggactacagatgcgtgccactac
gtccgtctgatgttttgtattttagtagagacagggtttcaccatgtt
ggtcaggctgctctcgaactccagatctcgtgatccgcccgcctgggcctacta
aagtgctgggattacaggcgtgagctagatctgactttctagtgtcctagcctt
ggcccgatggacatgtcatttctctcagctcgtttctgtcccctaaagtgagaa
tattgcctgggaagattacattagacgatgtatatgcgaagacacttgatagctgg
tattgtcatgattctgattagttcactactgctactttccctgtggcctaggcttgcc
tatttccagtgggcgagctagctagatcctcctcccttaaataagccag
tgttttttaagacagaatactacttgcatagtggacaataatatcttaaagaactgag
caggatgaaaagaatttgatagaaagcaggtttgaggagcacattggaggttgg
caggtttcgaggctgcttgagaggacttgggccgatctgggctgggcttggac
```

-continued
```
gtgaccctggcacccaggcaggtggatcccagctggggcttccattcac
gactttctggtccctggcaggacagagcgggatgccaccagctt
gtccaaagggaagttccaggagctcctggtgggcatcgttgtggagaatgac
gctggccgcggcgagatcaacgagttgaagcaggtggaaggggaggcttcgtgcag
cagccgcaaaggaaagctgattttcttctatgagtggaacatcaaactgggctg
gaaaggcatcgttaaagaatctggagtgaagcacaagggattgattgaaa
tacccaatctttctgaggaaaatgaagtagatgacactgagaatttacaacgggaatg
```

Homo sapiens GrpE-like 2, mitochondrial (E. coli) (GRPEL2):

(Seq ID No: 1149)
```
ctgcctctcagcccaaattggaaacatg
```

Homo sapiens xyloside xylosyltransferase 1 (XXYLT1):

(Seq ID No: 1150)
```
ccgccccttcatggccgccgcctggcgccggggctaagtggccgccggcgtccgggtac
ccgagggctctcccgcgttgctggcaccgctggcgccgcggtctcgtagcgcatg
```

Homo sapiens chromosome 7 open reading frame 60 (C7orf60):

(Seq ID No: 1151)
```
cctcctctggctgctgcctccgcagctccctcctcctacccacctcctccatctggg
gagcgtctgcgggggcctgaggggcggcggcggcggcggcggctgcgatatg
```

Homo sapiens tetratricopeptide repeat domain 39B (TTC39B):

(Seq ID No: 1152)
```
cccctcctttgcgctgggctgagcccagagccgagagcaggggtcggctctgag
ttccctgcttggttttgggtggcagcagccagaggaggaatatg
```

Homo sapiens motile sperm domain containing 2 (MOSPD2):

(Seq ID No: 1153)
```
cacccttctctgtctacctctgggcgggactgccgggtgatgaga
tactcggtcggcgacggtagaacgggcgacggcgacaaccgcaatcacatccacgac
ggtgatcatg
```

Homo sapiens major facilitator superfamily domain containing 6-like (MFSD6L):

(Seq ID No: 1154)
```
ggcccctttcggtccaacggcaggac
ctgggggctgtggccggggcggccgttgacctggtgaccgcggcgccgccccagac
cgggggcgcagtcccactcgctccgagcccggtcccccaagcctccctcccgggtac
ctgggggccgcgcccgccctgcgcccagctccgcctccgtcggcccaggcctgacagagc
ccggcagccatg
```

Homo sapiens consortin, connexin sorting protein (CNST):

(Seq ID No: 1155)
```
cttcctctctagccgccagtgctc
tatgctccgcggtcgcgggccgccagcctccagccggccagccgcgaggggtgcg
cagagggaggcggggcggaaaggcgagaggtgtctcctccaccggagccaggga
gaccccgagcaagctccgtgacagcacgtcggccgccatgtcgccgagtgggctg
gaaacagacccggcgcccagcggtagccctccttgcgcctccgattcccaga
catgcaaggtctttaatgtaactttaaatggttcaccaaaggatgctctaatg
```

Homo sapiens zinc finger protein 92 (ZNF92):

(Seq ID No: 1156)
```
gggcctt
gtctctcgctgcagccggcgctccacgtctagtcttcactgctctgcgtcctgtgctga
taaaggctcgccgctgtgaccctgttacctgcaagaacttggaggttcacagctaagac
gccaggacccctggaagcctagaaatg
```

Homo sapiens DnaJ (Hsp40) homolog, subfamily C, member 18 (DNAJC18):

(Seq ID No: 1157)
```
cccccttctctttcagcctcgggcacggggaggctcggcggac
ctgctgattgggaaccgatatg
```

Homo sapiens polymerase (RNA) I polypeptide D, 16 kDa (POLR1D):

(Seq ID No: 1158)
```
cctcctccctcctccgtcctccgcgccttccgtcggtcggtccttgcttcctgcttcgc
ctccgcgcctcgcgctatgggacagagcccccgatccgccagcaccacctgaggatccag
aaaccgccccagcgatg
```

Homo sapiens ring finger protein 182 (RNF182):

(Seq ID No: 1159)
```
ac
ctccctcccctcccaggcgccgccgcagccg
gagcggctcccgggccctggccgccgccggccaggaagaaatacttgtgttggctg
catttccagggatgctaccagagctcaaggctgtcacctggtcttgcccagaa
gagccgttcttagaggcaggacttgatgaaggctttcctgctgatggaataggttt
gctagagctggccttggaattagaacccttcatgtggcctttataaatgcgttt
gagacagagttatatgcagaagttgaaaatgcctggaagatttctggtttctttcac
tactatcctgccttttgcatcgctgccagatttggatgatatgatattcagaggggg
```

-continued
caccttaatcaaagccattcttcaacaagacccacctggcataa
gattgcacacataattcaagatg

*Homo sapiens* transmembrane protein 18 (TMEM18):

(Seq ID No: 1160)

cctcctctgtg
gattctggccaggccgggttcggcggttgctgtgagagcgggcttcccaacaccatg

*Homo sapiens* Hermansky-Pudlak syndrome 4 (HPS4):

(Seq ID No: 1161)

ag
gcctctctgccgcgcgcgcaggtacggggcagaagtcg
caggtacccagctgctgcccacatttctggtccagagtcccgaacccgagcactgg
gatgcctggctactccgagccaaggcactgatgtttgaactggaaacttcaaaac
gtttaataagagtcttcaggatgggtttgaactagacaagctagaaattcttta
gaacaccagctctagcatgcatctcccacttttggctttcctggagaggagcttgaa
gaggtggttctgcagacagccacagtgatacttaggaaaccagaggaatggattt
gacttttctgctaggattctctgttatagtttctccctgagttgtaagaggcatggaaa
tatacatgaaactgaagaacctgcaaggaagggaagtggaactttccatgctgag
tgaaaactaaccaagtggcagttgtgactgaaaacactgaaacctaccacgtccagat
tcactggattggggatagaggaacggtcacagctagggagaaagaagtgataccg
gaaaagaaacctaaatgaagagaatgaggatgactgcacagtagatg

*Homo sapiens* PTK7 protein tyrosine kinase 7 (PTK7):

(Seq ID No: 1162)

agctccttttcctgagcccgccgcgatg

*Homo sapiens* kelch repeat and BTB (POZ) domain containing 6
(KBTBD6):

(Seq ID No: 1163)

agttctcctgggcgcctagcattgtcgcccacgctgcag
tagcggcttctgcggctccaagccagcgggtcctgtgaaggcgagcagacgcgga
gaaaggacgcgggagtgagagagggtgagtcagccactgtctaaacgataacgg
gaggcggctctgcggggtagggttgaattcag
taaatgggctcgtgctgctgtctcttcggagacgctgc
tatcttagcgtcagcgagggaaggttgaggaggagccagagccgggtcctg
cagcgtttctcgccatcagcgcccgtcgccatctccaccatg

*Homo sapiens* sperm antigen with calponin homology and coiled-coil
domains 1 (SPECC1):

(Seq ID No: 1164)

ctttctttgactggagcggacccgccggacgcaac
cgcctcgccagccggagccagcgcgagctcggcacggtggacacccggtccgaggccgg
caagccggctggtgcccgagtcggccaagcatg

*Homo sapiens* ST6 (alpha-
N-acetyl-neuraminyl-2,3-beta-galactosyl-1,3)-N-acetylgal
actosaminide alpha-2,6-sialyltransferase 3 (ST6GALNAC3):

(Seq ID No: 1165)

ggtccccttatttggatctgcgggaatgtgggctggagaggtcctgccgtggtac
cagcctccagcctgcccccaggactgcccctgacccaggcgcgcccgctgctcggtgg
caggagggccggcggagcgccatg

*Homo sapiens* transportin 1 (TNPO1):

(Seq ID No: 1166)

gattctctttgttccg
cagccatttcaggccccggacaggaggcag
tgccgcttcggccgaaggcccgagcgcccgaggcgtctgggatg

*Homo sapiens* heat shock 70 kDa protein 8 (HSPA8):

(Seq ID No: 1167)

cttccttcgttattggagccaggcctacaccccagcaaccatg

*Homo sapiens* hyaluronoglucosaminidase 1 (HYAL1):

(Seq ID No: 1168)

ggctccttcctccaggagtctctggtgcagctggggtg
gaatctggccaggccctgcttaggcccccatcctggggtcaggaaatttggagga
taaggcccttcagccccaaggacatcctggctgccataccctgctcctgacttctcagggc
tggcagtcatcgactgggaggcatggcgcccacgctgggccttcaactgggacac
caaggacatttaccggcagcgctcacgggcactggtacaggcacag
caccctgattggccagctcctcaggtggaggcagtagcccaggaccag
ttccagggagctgcacgggcctggatg

*Homo sapiens* STE20-related kinase adaptor alpha (STRADA):

(Seq ID No: 1169)

agtcctcccggtcgccccactgcgcatggcacgttgcgtactcccctcccagcaac
cggtctggcggcggcgcggcagtaaaactgaggaggcggagccaagac
ggtcggggctgcttgctaactccaggaacaggtttaagttttttgaaactgaagtaggcc
tacacagtaggaactcatg -continued

*Homo sapiens* transmembrane protein 161B (TMEM161B):

(Seq ID No: 1170)

ccctctctttcgctgtttgagagtctctcggctcaaggaccgggaggtaagaggtttgg
gactgccccggcaactccagggtgtctggtccacgacctatcctaggcgccatg

*Homo sapiens* Usher syndrome 1C (autosomal recessive, severe) (USH1C):

(Seq ID No: 1171)

ggctcttttccagctcctggcagccgggcacccgaaggaacgggtcgtg
caacgacgcagctggacctggcccagccatg

*Homo sapiens* interleukin 12 receptor, beta 1 (IL12RB1):

(Seq ID No: 1172)

cag
tcttttctccttgctcagcttcaatgtgttccggagtggggacggggtggctgaac
ctcgcaggtggcagagaggctcccctggggctgtggggctctacgtggatccgatg

*Homo sapiens* Meis homeobox 2 (MEIS2):

(Seq ID No: 1173)

atcccttcctctctttctgttcgccctcttctccctgctcttttcccttccacccc
ctcctctgttctccctcacctcctgcgccccctccccttcccggggttctgacagtac
gatgagctgccccattacggcgggatg

*Homo sapiens* G elongation factor, mitochondrial 2 (GFM2):

(Seq ID No: 1174)

tttttcttttcgtttagatacattgccttttgcctaggctggcgtcgagactt
gaggccgttgcagactttggcgcggctcgcgcctcctgcttcaagagcccagcggtga
gagctggcctgcggcacgcggcctaatgccagacagtaacagtttggaggatcaagatg

*Homo sapiens* lamin A/C (LMNA):

(Seq ID No: 1175)

gagcctttt
gccccggcgtcggtgactcagtgttcgcgggagcgccgcacctacac
cagccaacccagatcccgaggtccgacagccgcccggcccagatccccacgcctgccag
gagcaagccgagagccagccggccggcgcactccgactccgagcag
tctctgtccttcgacccgagcccgcgcccttccgggaccctgccccgcggg
cagcgctgccaacctgccggccatg

*Homo sapiens* calcium/calmodulin-dependent protein kinase II delta (CAMK2D):

(Seq ID No: 1176)

cgctctttctctcgccgcgccgtcttgaa
gccgcgcgggctcgtgagcagcgcgaggccgccaaggtgcctcgcttcgccg
gagccgctgccgcccgccgagggaagccggcctcgggcgcgcacgtcgtcg
gagccccggcgcgccccgcgcctgagcctgctgacagcggccgctgggctcaggctgtcc
gctctgggctccgcggcctcggccccgctgcactccacctccgcccctcg
gactccctcccctctgctcttctactcctcctgctccagtgcggatcgtttcg
caactgcttgccac
tcgtcccgtgcctggctgttttttccatttcccggccccctcttcttgag
tactttaccccctgcatttggggacagggactggaaaaggggcgggtggagcgtccag
tggagaagaaggaagcgaggccccgcaggaggaggaggatcggcggactgtggggagga
gaccccacgccacccttttctggtcatctcccctcccgccccgcccctgcgcacac
tccctcgcgggcgagctactttcggaccaggaaagtaa
gagcggccctgggtgacagcgccgcggggccag
tcccggggttagccgcgcgtctgctcgcttctggtccgtcgcgctcccagccaggg
cacagcccggaccgaggatg

*Homo sapiens* calcium/calmodulin-dependent protein kinase II gamma (CAMK2G):

(Seq ID No: 1177)

ccgtctcctcctcttgctccctcggccgggcggcggtgactgtg
caccgacgtcggcgcgggctgcaccgccgcgtccgcccgcccgccagcatg

*Homo sapiens* interleukin 15 (IL15):

(Seq ID No: 1178)

tttttcttttcgccaggggttgggactccgggtggcaggcgcccgggggaatcccagctga
ctcgctcactgccttcgaagtccggcgcccccccgggagggaactgggtggccgcaccctc
ccggctgcggtggctgtcgccccccaccctgcagccaggactcgatggagaatccattcc
aatatatggccatgtggctctttggagcaatgttccatcatgttccatgctgctgacgtc
acatggagcacagaaatcaatgttagcagatagccagcccatacaagatcgtttcaact
agtgccccactgtgtccggaattgatgggttcttggtctcactgacttcaagaatgaag
ccgcggaccctcgcggtgagtgttacagctcttaaggtggcgcatctggagtttgttcct
tctgatgttcggatgtgttcggagtttcttccttctggtgggttcgtggtctcgctggct
caggagtgaagctacagaccttcgcggaggcattgtggatggatggctgctggaaacccc
ttgccatagccagctcttcttcaatacttaaggatttaccgtggctttgagtaatgagaa
tttcgaaaccacatttgagaagtatttccatccagtgctacttgtgtttacttctaaaca
gtcattttctaactgaagctggcattcatgtcttcatttggggatgcagctaatataccc
agttggcccaaagcacctaacctatagttatataatctgactctcagttcagttttactc
tactaatgccttcatg -continued

*Homo sapiens* protein O-fucosyltransferase 1 (POFUT1):

(Seq ID No: 1179)

gtccctccttccctccccgactgtgcgccgcggctggctcgggttcccgggccgacatg

*Homo sapiens* calpain 3, (p94) (CAPN3):

(Seq ID No: 1180)

cac
tctctttctctctccctctggcatgcatgctgctggtaggagacccccaagtcaacatt
gcttcagaaatcctttagcactcatttctcagga
gaacttatggcttcagaatcacagctcggttttaagatggacataacctgtacgac
cttctgatgggctttcaactttgaactggatgtggacac
ttttctctcagatgacagaattactccaacttcccctttgcagttgcttcctttcctt
gaaggtagctgtatcttatttctttaaaaagcttttcttccaaagccacttgccatg

*Homo sapiens* PTK2B protein tyrosine kinase 2 beta (PTK2B):

(Seq ID No: 1181)

agcccttttactcagccacagcctccggagccgttgcacacctac
ctgcccggccgacttacctgtacttgccgccgtcccggctcacctggcggtgcccgag
gagtagtcgctggagtccgcgcctccctgggactg
caatgtgccgatcttagctgctgcctgagaggatg

*Homo sapiens* ST6 beta-galactosamide alpha-2,6-sialyltranferase 1 (ST6GAL1):

(Seq ID No: 1182)

cttccttccttctccagtcccttccac
tgtgcgtcttctgtcccccgttcttcccagcggaccctctttcgagactccctag
tggggtcccagctcccgggcgatcctgcccttgccgagcgcgttttctggagtcac
ctgggggagggagtcctgggcagggccgggctggggaagacgcctggggcac
tgcccggcgttaacaaagggagccgataccgaccggcgtgggcgcg
gagcgggcggccgccaccgagcgtgctgagcaaccgcagcctccgcggccgagagtg
cagcgagcaaggggagagccagttgcgcagagccctgcaaccagcagtccaggga
gaagtggtgaatgtcatggagcccagctgaaatggactggcccctt
gagcctgtcccaagccctggtgccaggtgtccatcccgtgctgagatgagttt
gatcatcctgagaaaaatgggccttggcctgcagacccaataaac
cttccctcccatggataatagtgctaattcctgaggac
ctgaagggcctgccgcccctgggggattagccagaagcagatgatcatgacgcag
tcctgaggtttaatggggcacccacagccaacttccaacaagatgtgggcacaaaaac
taccattcgcctgatg

*Homo sapiens* ubiquitin-conjugating enzyme E2Q family member 2 (UBE2Q2):

(Seq ID No: 1183)

ctccccttccgcgcccggctccccttccgcgcccctcccgccggagat
gaggggaagatg

*Homo sapiens* membrane magnesium transporter 1 (MMGT1):

(Seq ID No: 1184)

gcttcttttgctgggctgctgctccttcggcatcatg

*Homo sapiens* PAP associated domain containing 4 (PAPD4):

(Seq ID No: 1185)

cggtcttccgggtgtctttgacagggttttctacgccgcttttcggcgacttttgctc
ttccgcttttgccaccgcccccaaccttctatatccttgcagcccctac
ctttcttgtgttgctcctcccctggcagccgtgagggggttagatctcagccg
gagccggagctggcctagctgtcccacgggccaccactacctcctttggttcggga
gaaagctacgaccaagtacgcccagctcgggccttagaacttctgaacgggcag
tgcgggtaggccctgcttagcccttcccggaggacacctgaccaaaagaggaaga
tagtcttgggacccttgcatggtgtttcaaagggtggtgaagaactaaggtagaa
gaatacatgttcacttccagtgaacaagagcatg

*Homo sapiens* chromosome 3 open reading frame 23 (C3orf23):

(Seq ID No: 1186)

ctcccttctggtgtactgggtggggtggaactagtcggacaaagccctcgcgtcg
gacccttgccagaactcaattaatggatgcctcgaagttgacgtacatatatattca
gaaatg

*Homo sapiens* mucosa associated lymphoid tissue lymphoma translocation gene 1 (MALT1):

(Seq ID No: 1187)

cgcccctttt
gcgcggctggcgcggccagccggccaggctcccctcggcaaacctgtctaatt
ggggcggggagcggagcttcctcctctgagggccgtgccgcgctgccagattt
gttcttccgcccctgcctccgcggctcggaggcgagcg
gaaggtgccccggggccgaggcccgtgacggggcgggcgggagcccggcag
tccgggggtcgccggcgagggccatg -continued

*Homo sapiens* UDP glycosyltransferase 3 family, polypeptide A2 (UGT3A2):

(Seq ID No: 1188)

ctacctctacccacagccagtgcctttggcgcactgaggtg
cacagggtcccttagccgggcgcagggcgcgcagcccaggctgagatccgcggcttccg
tagaagtgagcatg

*Homo sapiens* sodium channel, voltage-gated, type IV, beta subunit (SCN4B):

(Seq ID No: 1189)

cctcctctcgctctctgcccgctaactttcccgagcccgac
cggcggcgcagagctccggggtagctttgtggccgaacgccgacctcgggcgga
gagcgcggctgtgccagtatcccatccccgcgaccccgcgcgctccggagagaacag
gactatg

*Homo sapiens* JAZF zinc finger 1 (JAZF1):

(Seq ID No: 1190)

tccctctgcctcccggtggctcctcgctctccttccatctctctcgcccctctccctc
cgtcccgtcctcgccgctccctcaccccgcctctctcccctccccagccctcctct
cctcaccccaccccggcctccctccctccctcgcccgcccggcgctcgcagagccgacac
caggggggctctcgatgtagcaccatg

*Homo sapiens* chromosome 15 open reading frame 55 (C15orf55):

(Seq ID No: 1191)

ttcccttccttggatccctgtgcacctactggagccaggttactctgggtcctggac
ctgactgcctcattctggaggcttccagacagccacagttagtgcccaaacctgagag
gatg

*Homo sapiens* ras homolog family member C (RHOC):

(Seq ID No: 1192)

cgccctctcttcctgcagcctgggaacttcagccggctggagccccaccatg

*Homo sapiens* CTP synthase II (CTPS2):

(Seq ID No: 1193)

cattctctttccttttccttctctcctgagcgctcctgcagttcctggggcgtag
tagggatccacaagcgtttgtgaccagtgaagttctttacaagggtgagatctgcac
gggaggacccgagcgagggtctcggcttgccaggaagccgggggttcccgggaagcgtg
gagttcaccgcgcactcgaagtgcctttgcaaaattatatctgggtgttgg
cacccagccactattctgccaatg

*Homo sapiens* PRP4 pre-mRNA processing factor 4 homolog B (yeast) (PRPF4B):

(Seq ID No: 1194)

agctcttttccttcttcctccacttcccctaccctccac
cgtccgggagccgccgccaccgccgcgaggagtcaggaagttcaagatg

*Homo sapiens* molybdenum cofactor synthesis 2 (MOCS2):

(Seq ID No: 1195)

gcgcctttgcggccgtgattcggtcccgctgtcctaggcgg
gatggtgccgctgtgccaggtaagggtggcgggtgtgcgtgcgggcctgggtgcg
gagccctcctcgacgtgtctctcccgcccttccctccacataccccagccttggtcag
tcggacctcccactagccccaacctggccggcgtctt
gggttcgggggcgcccccgccccgcccggggcccttcctgtctccgggctttactgcg
actgccccagcagaagtcgggtcctccgagaactcttgtcagctcacggcag
caaggacggactcgttctgaaggcgcctccacctttatgaccacctctttcccagat
tattcgttttgatgaagctaaaattttaatctaaaaagaaatgcacctcatgga
gaattcttgtgaagaactgtgcttcatctgtggatttctacaccttgatcattt
gcaaacctgtaattattcgtaaagagttgtttgcacggagtgacaggtt
gaagtattgtattttgcaaaaagtgctgaaataacaggagttcgttcagagac
catttctgtgcctcaagaaataaaagcgttgcagctgtggaaggagata
gaaactcgacatcctggattggctgatgttagaaatcagataatattt
gctgttcgtcaagaatatg

*Homo sapiens* cat eye syndrome chromosome region, candidate 1 (CECR1):

(Seq ID No: 1196)

tttccttttccggaggggagatg

*Homo sapiens* solute carrier family 13 (sodium-dependent citrate transporter), member 5 (SLC13A5):

(Seq ID No: 1197)

ctgccctcactcgtctcgcccgccagtctccctcccgcgcgatg

*Homo sapiens* armadillo repeat containing, X-linked 3 (ARMCX3):

(Seq ID No: 1198)

agtccttcttgtcctggtcgttgttcccgtctgagtaccagctccccactgccctgaggg
cgggccggcctgcggcggagggaaaaaggaagaggagaaggaaattgtcccgaatccctg -continued cagtgggtccaagcctctcccgggtggccagtctttctgtaggttgcggcacaacgccag
gcaaaagaagaggaaggaatttaatcctaatcggtggaggtcgatttgagggtctgctgt
agcaggtggctccgcttgaagcgagggaggaagtttcctccgatcagtagagattggaaa
gattgttgggagtggcacaccactagggaaaagaagaaggggcgaactgcttgtcttgag
gaggtcaaccccagaatcagctcttgtggccttgaagtggctgaagacgatcaccctcc
acaggcttgagcccagtcccacagccttcctcccccagcctgagtgactactctattcct
tggtccctgctattgtcggggacgattgcatg Homo sapiens armadillo repeat containing, X-linked 2
(ARMCX2):

(Seq ID No: 1199)

cgtcctcctctgggtaccaactctattgcg
cagctcgctgccgtgcgtttaacccaggcgaggaggaggaggagaaaattcccccagat
tcgggcaggcccgcaccccacattccgtcctgttttgagaggaggagggaagagaaa
taaacgtggcagcgcatagaaggccagcagggagactgctttccagacac
ctccggcccacacagccgttcacccccgtcttttcagtcctg
gaaaaggaattcggtctgtccttaggatgaagctctaactgaactgaagtaagga
gaaacagccttgaatctttggagggtctgtcttccttttgggctctgtgcaactgcagc
tacagtggaaaaaagcaaactgctcttgatcccaggccctgcctaagcctcag
cagaacttgtaagcctaaactgaagagcctcacccggacgagcaggcatcccttaac
cttaagcaatccagttccacgccctggatcagtgaataaccccagctgcaccatg Homo sapiens UBA domain containing 2 (UBAC2):

(Seq ID No: 1200)

cgccctctgggctccgagcccggcgggaccatgttcaccagcaccggctccag
tgggctctgtgagtaccggcctccgccatcctggctgcccctacac
gccaccctaggcacctctttgaggaggctggggcagcgggaccctcgggtttgccg
gaggtggtggggccgaccctccagacccgcgtccgaaccctgctagttcccggtctt
gggggtcagcggaaaccgccccattcggcctggaggggcgaatggggacaaa
gccccgccgcccgccccgaccccacctggtatccccaggtgctctgcccaggag
tctcttgggccgctgcaagtggg
caggtgccctggtgttctcgtgggccggccccaggcccttgcg
gagcgtgtgccgcgctgaaggaaggggccgtcccccttac
catgcccattcttttaggcttgggggaccgaactaactcccccgcccccactt
gcaaagttcagcctccgctttagaagctgacctctcagtttcacttggatg Homo sapiens cancer susceptibility candidate 4 (CASC4):

(Seq ID No: 1201)

cctcctccctcggccggccctggggcgtgtccgccggg
caactccagccgaggcctgggcttctgcctgcaggtgtctgcggcgaggcccctaggg
tacagcccgatttggccccatg Homo sapiens protein phosphatase, Mg2+/Mn2+ dependent, 1G
(PPM1G):

(Seq ID No: 1202)

cgctccctcacagctcccgtcccgttac
cgcctcctggccggcctcgcgcctttcaccggcaccttt
gcgtcggtcgcgccgcggggcctgctcctgccgcgcg
cacccccggggcttcggctccggcacgggtcgcgcccagctttcctgcac
ctgaggccgccggccagccgccgccatg Homo sapiens StAR-related lipid transfer
(START) domain containing 13 (STARD13):

(Seq ID No: 1203)

cttttctttttaaaaatcgctgggtctgttgagctgtcctgggctgggtgcctt
gctctttgactgagactggacagacggcaacagccacaggcagactgaggtggcaa
taggaaatctgccgagatg Homo sapiens tubulin, beta class I (TUBB):

(Seq ID No: 1204)

gattctcccgcctcccagcccggcgcacgcgcgccccgcccagcctgctttccctccgc
gccctcccctctcctttctccctctcagaaccttcctgccgtcgcgtttgcacctcgctg
ctccagcctctggggcgcattccaac
cttccagcctgcgacctgcggagaaaaaaaattacttattttcttgccccatacat
accttgaggcgagcaaaaaaattaaattttaaccatg Homo
sapiens cytochrome P450, family 4, subfamily X, polypeptide
1 (CYP4X1):

(Seq ID No: 1205)

tttccttcttcccgcgagtcagaagcttcgcgagggcccaga
gaggcggtggggtgggcgaccctacgccagctccgggcgggagaaa
gcccaccctctcccgcgccccaggaaaccgccggcgttcggcgctgcgcagagccatg Homo sapiens doublecortin (DCX):

(Seq ID No: 1206)

ttttctttctctcag
catctccacccaaccagcagaaaaccggtgagtgggcttttaagtgattttcaagaa
gaatgtaacagatgtcaaacgggaaaagcacaaggcaaa
gcctgctctctctgtctctctgtctcctcttctcctttttgccttattctatccgat -continued tttttccctaagcttctacctgggattttcctttggaaaagtctctgaggttccac
caaaatatg

*Homo sapiens* protein phosphatase 2, regulatory subunit B', gamma (PPP2R5C):

(Seq ID No: 1207)

ttgtctttttttttttaaactaaaatggaggctggtttctt
gccttaaggagcccattgcctttcccgctgaagtctagatg

*Homo sapiens* solute carrier family 9, subfamily B (cation proton antiporter 2), member 2 (SLC9B2):

(Seq ID No: 1208)

ccacctttccgggg
gaagccacgcgcaccaggcatcgcacgcggctctgcacccgcgccgccggac
ctgaaacccggcggagggcacacggggctgccgctgcgggccccggac
caacccatgcttactccggagcctgtaccggcgccgacgggtcggac
ctccctgcgcggtgtcgcccagcgggttcgtgcgaaaggcggggccgactacac
gcggtgccgcgccctgagaccgtttatctgcagtcaac
gcagcctcccggctcagcctgggaagatgcgcgaatcgg
gaacccagagcgcggtggctagac
cgggctccgccgcctcccccacagccccttcctaatcgttcagac
ggagcctggtcgacttcgccgga
gactgccagatctcgttcctcttccctgtgtcatcttcttaattataaataatg

*Homo sapiens* hypoxia inducible factor 1, alpha subunit (basic helix-loop-helix transcription factor) (HIF1A):

(Seq ID No: 1209)

caccctcttcgtcgcttcggccagtgtgtcgggctgggccctgacaagccacctgagga
gaggctcggagccgggcccggaccccggcgattgccgcccgcttctctctagtctcac
gaggggtttcccgcctcgcaccccacctctggactt
gcctttccttctcttctccgcgtgtggagggagccagcgcttaggccg
gagcgagcctggggccgcccgccgtgaagacatcgcggggaccgattcaccatg

*Homo sapiens* interleukin 21 receptor (IL21R):

(Seq ID No: 1210)

cctcctcttcctccccactctgcacatgcggctgggtggcagccagcggcctcaga
cagaccactggcgtctctctgctgagtgaccgtaa
gctcggcgtctggccctctgcctgcctctccctgagtgtggctgacagccac
gcagctgtgtctgtctgtctgcggcccgtgcatccctgctgcggccgcctggtac
cttccttgccgtctcttttcctctgtctgctctgtgggacacctgcctg
gaggcccagctgcccgtcatcagag
tgacaggtcttatgacagcctgattggtgactcgggctgggtgtggat
tctcaccccaggcctctgcctgctttctcagaccctcatctgtcaccccac
gctgaacccagctgccaccccagaagcccatcagactgcccccagcacac
ggaatggatttctgagaaagaagccgaaacagaagatgaggcaatgaggctgcga
gaggtagagtgattttccctcggtgactcaactgggacgtagcaggtcgggcagtcaa
gccaggtgaccccatg

*Homo sapiens* DDB1 and CUL4 associated factor 4 (DCAF4):

(Seq ID No: 1211)

tggtctttccggggtccttgcacgcttcgctccaactcctgcagagctgagccggaggg
gaatccggaagggacacgctgaacaggtctgactcccggggcagcacagcccgctcac
gattccggccacggtgatgacgagtctccgtcaacctcgtctggcacagctgggac
ctcctctgtgccagagctacctgggttttactttgaccctgaaaagaaacgc
tacttccgcttgctccctggacataacaactgcaacccctgacgaaagagag
catccggcagaaggagatg

*Homo sapiens* oxidation resistance 1 (OXR1):

(Seq ID No: 1212)

ccgcctctt
gtgaggcgcgcggagccgcctcccctgggtcaggtctgatgggccggtgggcgcgctag
tggtggccgccaccgccgaaaccgtcgacctcctgggccccag
ttccgcgtccagccccgcggcagcatg

*Homo sapiens* cut-like homeobox 1 (CUX1):

(Seq ID No: 1213)

cccctctctat
cagccgctcactccgtctcaatatgtctcaagatg

*Homo sapiens* atlastin GTPase 1 (ATL1):

(Seq ID No: 1214)

ctcccttttcctccccac
tccttcccaccagcgccacagcaacatcctcagag
tctgagcgaactgcgcccagcgcgggcacggagcctccaccgccagcaac
ctgcggccccggagaaggcagcgagcgcagtgacagcgcctcaccgccaccagctcctg
gaccaccatg

*Homo sapiens* chemokine-like factor superfamily 5 (CKLFSF5):

(Seq ID No: 1215)

ctgccttctctcccggggccctgtgggcaagcctcctgcttcac
tttcaggtttctcgaagtgccttcttgctcctgtctgtttcccatcctgccagat
ttctgtttctcttgctgggcttttggcagtaggggggctgtgttggtgggccctacgaa
gatg

*Homo sapiens* transmembrane emp24 protein transport domain containing 7 (TMED7):

(Seq ID No: 1216)

aggccttttccgcttctcttttacctccccaggtccgcccgtctgcgcccctcacaggaa
gccggagggtcgctctgatcccgaatctcccacaggcgtgaacctgctctgctgtgtatc
tttgcggggtggcctgcgctgaggcctgccgcgcggtgagtccgcgcagacctgaccc
tgcgtctcgcagctcggttgaggccgccgccgccttctcgggatg

*Homo sapiens* ubiquitin-conjugating enzyme E2D 3 (UBE2D3):

(Seq ID No: 1217)

cttcctttac
cttcctcccatggtctccttccggttctcgatgcttctctgagcctaagggtttccgcca
ctcgttcaccctcccccagctcatgatcctcctccctccccgccctcctggtccaatc
tccgatctgtttagtaagaaggtgctgttccgagaagaaggaaaagggcttgacac
gtattcactcggccccggacgtgggaagcaa
gccgtctggcttcggcctcacatcggtcttgtgctcgggacggcggcgttggcg
gactgatccgcggcggtgaagagaggccgggaagttaaacttgtagccaccac
ctccgctcttcccgtcaccctcgcccccacttcgggccgaaagcacgg
tacagaggctgttggtggctttgccacgccacccaccccacccccg
gatcgcggctgtcttaagggacctggattcatcagggggctcttcggggcctgtgcgag
tgctgatctgctccgttttgcaaaaggcgcctgtgtctggcagagctggtgtgagac
gagacaatcctgccccgccgcgggataatcaagagttttggccggacctttgagcata
caccgagagagtgaggagccagacgacaagcacacactatg

*Homo sapiens* zinc finger protein 595 (ZNF595):

(Seq ID No: 1218)

tttcctctggctcctgcgagggctt
ggtttagggcttcagctctctgcgttctcggctccgggaggcctcggtgat
tcagccacagcctctgcctcccgttgctctgtgacctgagggtattggacaattt
gtagctaagactcccggataccctgaagtcgggaaatg

*Homo sapiens* acyl-CoA synthetase medium-chain family member 2B (ACSM2B):

(Seq ID No: 1219)

tgctctcttccaaggctgtaggagttctggagctgctggctggagag
gagggtggacgaagctctctccagaaagacatcctgagaggacttggcagcctg
cagatggcctattgtgggaccttgtgatcatgcctgaacatg

*Homo sapiens* SRSF protein kinase 2 (SRPK2):

(Seq ID No: 1220)

tttcctttatagcaccattgaatcccagtcctaacagaagtactgcgaatctt
gtggcctcattctgaacaaaagggattagagaagaaaaatctcttgatataaggctt
gaaagcaagggcaggcaatcttggttgtgaatattttctgattttttccagaaatcaa
gcagaagattgagctgctgatg

*Homo sapiens* synaptophysin-like 1 (SYPL1):

(Seq ID No: 1221)

tgcccttcctcgccac
cgggctgctctggtctcgtcggtcccctcctccgccccgtcgtcctgactctctctccct
cctttcctcagaggatg

*Homo sapiens* thioredoxin reductase 1 (TXNRD1):

(Seq ID No: 1222)

aacccttcac
ctcagttttcttcactccggcatttgcagcagagcgaaaggtggtcgag
tcctgaaggagggcctgatgtcttcatcattctcaaattcttgtaa
gctctgcgtcgggtgaaaccagacaaagccgcgagcccaggatgggagcacgcgggg
gacggcctgccggcggggacgacagcattgcgcctgggtgcagcagtgtgcgtctcggg
gaagggaagatattttaaggcgtgtctgagcagacggg
gaggcttttccaaacccaggcagcttcgtggcgtgtgcggtttcgacccggtcacacaaa
gcttcagcatgtcatgtggcttatcaggagggcagacttcaaaagctactaaaaatg

*Homo sapiens* minichromosome maintenance complex component 7 (MCM7):

(Seq ID No: 1223)

tgtccttccgcgcggcggccgcggagagagctgcggcccggggggcgtgcctgggatcc
ggagcttcgctcgggcccgggaaaggcggcagtgggtcggatgcggcgtgtctctgggtg
tgatggccaatggctggactggctcccgccctgggcggaggaatcccgagctgtgaagcg
gctggaatccgggcccatgtgcttctttgtttactaagagcggaagcgatggcgggagcg
ggggtggggtgcggtggcgggtgcggtggcggaggtcccggtgaaatcaggggctaagg
ggacccaaagaaggcgggggatcataggggtggaaagaaagctgagaaccttgagaccgg
agtgtgaggggccaacgggaagggcgctagaattttaaactaaagtaggaccggaatt -continued ccccctggggagatgttggatggccctgtgcactgccacgggctctttattcttcgctggt
tagaaacagacttgtgaaaaagagttatgcccacttggggagacttcgaaaaggttaag
aagttcttacaagagttctaccaggatgatgaactcgggaagaagcagttcaagtatggg
aaccagttggttcggctggctcatcgggaacaggtggctctgtatgtggacctggacgac
gtagccgaggatgaccccgagttggtggactcaatttgtgagaatgccaggcgctacgcg
aagctctttgctgatgccgtacaagagctgctgcctcagtacaaggagagggaagtggta
aataaagatgtcctggacgtttacattgagcatcggctaatgatggagcagcggagtcgg
gaccctgggatggtccgaagccccagaaccagtaccctgctgaactcatgcgcagattg
tgagtggtctctgtcgggaaagatgtagggattggttctccaggatcttgtttgtgactg
ttttctccccttagtgagctgtattttcaaggccctagcagcaacaagcctcgtgtgatc
cgggaagtgcgggctgactctgtggggaagttggtaactgtgcgtggaatcgtcactcgt
gtctctgaagtcaaacccaagatg Homo sapiens pre-B-cell colony enhancing factor 1 (PBEF1):

(Seq ID No: 1224)

tttcccctctcccctcctccgccgaccgagcagtgacttaagcaac
ggagcgcggtgaagctcattttctccttcctcg
cagccgcgccagggagctcgcggcgcgcggcccctgtcctccggcccgagatg Homo
sapiens cyclin B1 interacting protein 1, E3 ubiquitin protein
ligase (CCNB1IP1):

(Seq ID No: 1225)

ctttctttccctctccgttttggtgggctggtt
gaagatgaaatccactgaggagggaagtccagcaccctgtgtgccag
tccagaactggcccatctgtagaccccctgaaaatcatatgggcttggatttgga
tattctcaacagaaagggttaaaggctgatggtacctaaagcctggtacttgaatttt
gatcaagataagctgccttaagttctcttcattacacaaatgatcctagataattgata
gatcctgtggttcaactggatttctagatagaagctggattcatgtgatgccagaggag
taaaatttcaagagactgaaaccagatctgagtttcgctgttccagtctggacctcttt
ggtgctgtaaatcctggatatactgtagatgag
tactgcgttttctttatggcctctcttcagcttctggagacctcactatcctattatg Homo sapiens STEAP family member 3, metalloreductase
(STEAP3):

(Seq ID No: 1226)

ccgccttcgccgcggaccttcagctgccgcggtcgctccgagcggcgggccgcagagatg
acatttattcatttatgcatcctgggttctactggtcgtcccacctcagttcctgtagc
aaagagacttgagtctgagccactaattatcacccgtgaggttcctccccgagcaggaa
gcagcaggccagagctgcgctctctcagtgcactctccaaccaagcatcagtcaccactc
ccggtccagcccctgtggccaagagctggcgtgcaggctgcggaggcagctggctgtgc
aagaccctggcagggccctcgcctcctgagaaaccgagagtcagaaccaaagccaggctg
tcctggttggagactgagccagaaagggtggctcacctcacggtgaggctgtcgagtgac
ctgagagcctcagaccctcacgtcagccgatg Homo sapiens nicotinamide nucleotide transhydrogenase (NNT):

(Seq ID No: 1227)

tgttcttccgggttggaggcgcagcgccgcggggcccaa
gcccgggtctgccagcgcgacgtcctctcgcggccctcaggg
cacagcccaaggctgtcagcctcccggcccagtgatttgccttcaaggaaactggggag
tcagaaaattgggaactcatatcaacatg Homo sapiens SHC
(Src homology 2 domain containing) transforming protein 1
(SHC1):

(Seq ID No: 1228)

gtccctctccctcccccag
gacttctgtgactcctgggccacagaggtccaaccaggctaagggcctgggga
taccccctgcctggcccccttgcccaaactggcagggggccaggctgggcag
cagccctcttttcacctcaactatg Homo sapiens bromodomain containing 8 (BRD8):

(Seq ID No: 1229)

cggcccttcca
gaccgtctctcctcaggggttggagacttcggggccaagatg

Homo sapiens ring finger protein 13 (RNF13):

(Seq ID No: 1230)

tcgcctctttag
taggtcgggtgagtgtagtgtgcagggaagagac
gcgtcagcgccagggccaggcccgccggggcagccccggcagccgaatcttgggc
tactctgtcccaacagccggagcagatcagaccgac
cggccctgccgctcggtcccgcgccctccagacccacggtctccgtttctagggg
cacatggttagcggcaggcgcccacagccaatccactttt
gccagcctgccccttcctctgccaagagcagcttcttcagccgcgctccagttccg
cagacgcctgccccaccctgctcttcccttccagggaagacggatcacgcggccaa
gaacgagactcgcaaactgggcatttctccgagccgggctagagcaagtagcga
gactccgcgtgagagtgggaaagagccttaacaggcaaccatgttgcccag
tgggttttctgtgcctttgggtgcggaccaatgaggcgcgtggggcgg
gacttccgcttcgcctaggtgttgtcgtccctgctag
tactccgggctgtgggggtcggtgcggatattcagtcatgaaatcaggg -continued

```
tagggacttctcccgcagcgacgcggctggcaagactgtttgtgttgcgggggccg
gacttcaagagagaaagagagagtgggcagacatcgaagccaaacagcagtatcccg
gaagcactcatgcaactttggtggcggccactcagttttctctgccagtgtctggtgat
tttacaacgagatg
```

Homo sapiens aldolase A, fructose-bisphosphate (ALDOA):

(Seq ID No: 1231)

```
ccgcctcctgcgccgcccttccgaggctaaatcggctgcgttcctctcggaac
gcgccgcagaagggtcctggtgacgagtcccgcgttctctccttgaatccac
tcgccagcccgccgccctctgccgccgcacccgcacacccgcccctctcctgtgccag
gaacttgctactaccagcaccatg
```

Homo sapiens LY6/PLAUR domain containing 6 (LYPD6):

(Seq ID No: 1232)

```
cgctcccttccctgagctcccgggctccggcagcgcgctggcggggcgccgcatt
gcacactctgggggcgccgcagtgttcgtgggatggggcagcgggctg
cagctggcggccggaatccgcgcgcagcccgggtgcaagttctctcctgttgccctgag
tgcccactcccaggccctctgtatgagtgacacttcagtctgccatg
```

Homo sapiens butyrophilin, subfamily 3, member A1 (BTN3A1):

(Seq ID No: 1233)

```
cagtctctgctttcttttcctttcttccagaaggagatttaaccatagtagaaa
gaatggagaactattaactgcctttcttctgtgggctgtgattttcagaggg
gaatgctaagaggtgattttcaatgttgggactcaaaggtgaagacac
tgaaggacagaattttttggcagaggaaagatcttcttcggtcaccatacttgag
ttagctctagggaagtggaggtttccatttggaattc
tatagcttcttccaggtcatagtgtctgccccccaccttccagtatctcctga
tatgcagcatgaatg
```

Homo sapiens lipoic acid synthetase (LIAS):

(Seq ID No: 1234)

```
ctgtcctttcccgg
gagttagcgatccctcaaccccctgcactgcgctagtcctaaagaggaaatg
```

Homo sapiens C-type lectin domain family 7, member A (CLEC7A):

(Seq ID No: 1235)

```
gattctcttttgtccacagacagtcatctcaggagcagaaagaaaa
gagctcccaaatgctatatctattcaggggctctcaagaacaatg
```

Homo sapiens CD247 molecule (CD247):

(Seq ID No: 1236)

```
actccttttctcctaac
cgtcccggccac
cgctgcctcagcctctgcctcccagcctctttctgagggaaaggacaagatg
```

Homo sapiens myeloid zinc finger 1 (MZF1):

(Seq ID No: 1237)

```
aa
gcctttctccatttttgcggtctaggaagtagcagaggccccttcctgtagggagtt
gccatggagacgcggtggggcaccgacggagttctaatgacggccgtgattggtgcag
gatcctgctaatctcaggaaggcccgtagagaagtgaggaaaacgtggtgggggg
catgcgcgatctggtaggcggtgctgccgtctgttgtacctgagaggcttgcg
catgccgacgcacggattcgaggcggggagcatgggaagaagcggccaggagtatgac
ctgatcattgcgaccaccgctaggggaagggaggagagggtgtagaaacggggac
gagggtgggggaagggcaaggaggcgctcgagctggtgcgcgggagcatcctgggagac
gtagtccagcgggaggggggaagtcgaagactgcgcgtgctcaggagcgcg
gagcggcccgctgagcggcagaggggcagacactggcctcagatacctgacctgg
taccctctatg
```

Homo sapiens E2F transcription factor 6 (E2F6):

(Seq ID No: 1238)

```
cctcctcttttccgtctgcgtcgggagctcccgggcac
gtgaggccgtgccgcgtttactggcgggcgggacggcctagccgggcggcgcctcggag
gaagccgcggaccccttaggtgctgggcccctt
ggaaatcggcgcgtgggggcggtgctcgagctgagcgcgagagggcggga
gagctcgtgggtgcgaggggagcaggacgccggccgggcagcatg
```

Homo sapiens purinergic receptor P2Y, G-protein coupled, 10 (P2RY10):

(Seq ID No: 1239)

```
cttcctcttttcaacaacaaatgtgtcagttatcagcaggatccatgccgccagagtaaag
cttttctacccttttactccctgcaaagaaacaagagtgcttatcccagctaagctccaggg
taatgttatcatgacagcttcaacttttagaccacaggcaaatgctttgttaaaactcta
tgctggtcattcccttcaggatttggcactcaccaacatacccttctttcaagtgaaaag
gcatctcttttaatggtcctgacctttggaataggaagcatgtacccctggacagagcact
tcaaactagaggaaccataaatccatg
```

-continued

*Homo sapiens* chromosome 9 open reading frame 85 (C9orf85):
(Seq ID No: 1240)
catccttttgcctgctcccggcgaggggtggctttgatttcggcgatg

*Homo sapiens* ERGIC and golgi 3 (ERGIC3):
(Seq ID No: 1241)
cgtcccctttccggccggtccccatg

*Homo sapiens* ankyrin repeat domain 46 (ANKRD46):
(Seq ID No: 1242)
ccctcccctccgcccgtcaccgcctccttgaa
gctgccgctgtcgctgctgctcgttcgagtcgcagatccttgccagcacattacagaa
tattttttgttgaaccttcttgagaattcagagaaactgctgagtgaccactgaac
gaaaagatctaatcttaaggcttacgcctcactttgatgcccaggctggag
tgctgtggctcaatcacagctcatcgcaacctcgac
ctcccgggctcaagtgatcctctcacctcagcgtcccgaacaggcgtgttccatccac
cacatcagaacaatg

*Homo sapiens* Ras and Rab interactor-like (RINL):
(Seq ID No: 1243)
tcctctctccacttcctgctactgcaggcctctcctccga
gaacagaggccaggtcatgactcactggcttcctgcaacctgac
gatggcccagccagaagacaaggcac
ctgaagtccccacagagggggtgaggtgaacaaagcagacag
gacccctctagggggtcctcagcaccctagagccacttactcgcctgcagag
gacatggggggtgtggcatgtgccagagctggataccccaggatgcggaggcccctt
gtggggctgtggccactagggagtttcttggtcacaggac
gtgaccccagccaggccctggtgttgaggtcaggacctttaccaggagaagtcaatac
ctaccagatccagaagattcccagaggtgtgtccctggaatcctccaacctctgcatg

*Homo sapiens* embigin (EMB):
(Seq ID No: 1244)
ccgccttttcttcagcgtcctacccgcgg
cactggctgcgagcgccgggccacctgcgagtgtgcgcagggactctg
gacacccgcggcggcgagctgagggagcagtctccacgaggacccaggcg
gaccctctggcgccatg

*Homo sapiens* MMS22-like, DNA repair protein (MMS22L):
(Seq ID No: 1245)
ccgcctttccggagcgcgggcgcgcggtggcgggaatttcgcctgtttgcggttta
gaccccaaagattcctgttggtggtctgggtcacaggaggcaggttcgggagctg
gaaatgtgagcgggtacgacaggcaccgcgggtaaccgacgccccgggtccttgctg
cagccgggtacgcgggataccggcaccccgccttctccgcccgag
tgctgccaggcgtgggcctggaatctcttcacaccttctcttggagccccttaatga
tacgacgaaccccaagtgtttcagaacatgaagtaaacaatg

*Homo sapiens* chromosome 19 open reading frame 54 (C19orf54):
(Seq ID No: 1246)
actccttttccttttccagtggttatcgcggcgcccaccggcctctgatctctgagtctt
ctccaacccacagacgtttttttgttgctctggttccaggaccttctccacaactaggcca
ttttccctgccaggtgtccttttttgacctcttgacctctgactcaaagggcctgctcccc
ctcatgtcttcggcctggagaagagccagctcctgaaggaggcctttgataaggccggcc
cggtccccaagggcagagaagatgtgaagaggcttctgaaactacacaaggaccggttcc
gaggtgacctgcggtggatcctcttctgtgcagacctgccgtccctcatccaagaaggcc
ctcaatg

*Homo sapiens* zinc finger protein 621 (ZNF621):
(Seq ID No: 1247)
cgccttccggctcggcctttagttagtgaccagctcctcggcgttctg
cagagcgtgggtttcagcgagttctac
gtgccaggtccgcgcccggtgccggcttcctcgctgcccctggcggctcgtcagccccac
tacccctgaacttggtcccaatggcggccccgcccctccttcacccggaccgtggg
catctgggcctcgccgaagccgtcaaggtggctgctcgggcttcta
gagcccgtgtccagccctttgccaccgaggcctgatcctctttctgccctaaa
gaacttgccctgacagcctctggctcccgctcttgaggatcttgctt
gtccaaacccagaagacagtgcatgaagcaggggacatccgccatg

*Homo sapiens* family with sequence similarity 73, member A (FAM73A):
(Seq ID No: 1248)
ccgccttctccatg

*Homo sapiens* RNA binding motif protein 43 (RBM43):
(Seq ID No: 1249)
ccgcccttttcttcgtagcctccaagggagctggaacaaaaaacgaaaccaaaac
ctgcctgctcgctcctctcccatcgcctgcgttccgctggtt
gtgggctttctgcggccgctgagggcgcgtctcccctccgccatg -continued

*Homo sapiens* spermatogenesis and centriole associated 1
(SPATC1):

(Seq ID No: 1250)

caccctccttcagcccaggcaaggcctggggccctggg
cagcctccaggtgcagtgccctcccgtgggccgcacccttgccactgccccagggcatg

*Homo sapiens* carbonic anhydrase XIII (CA13):

(Seq ID No: 1251)

ctttctcttccttccaccccgagggaccatg

*Homo sapiens* transglutaminase 2
(C polypeptide, protein-glutamine-gamma-glutamyltransferase)
(TGM2):

(Seq ID No: 1252)

cgctctccgcctcggcagtgccagccgccagtggtcgcactt
ggagggtctcgccgccagtggaaggagccaccgccccgcccgaccatg

*Homo sapiens* NOP2/Sun domain family, member 4 (NSUN4):

(Seq ID No: 1253)

atttcctttcccttttttcgctcgtgtcccgccgggtggcgctcaccacctccccg
gaacacgcgagtctcctgtcgcggttccggtcggaattacccgtggagcacgccga
tatg

*Homo sapiens* mitochondrial ribosome recycling factor (MRRF):

(Seq ID No: 1254)

gagtctttccttagtaacctgggcgatagctgtggatgtttccaaggattgtcttcagt
catg

*Homo sapiens* PHD finger protein 17 (PHF17):

(Seq ID No: 1255)

cttcctccataacaagccaaacgccagaccgagagtgcctccgtgcgcgagtgcccggtg
tgtgcgcgccggcgagagcaggggcccgcccggctccccgcccgccgcggcccgaactca
tgcagctccgagcgagcgagcggcgcccagcccagcgcctcggccgaacccctccgcagc
aggctgcctgctgtttccggggagatcatg

*Homo sapiens* prolylcarboxypeptidase (angiotensinase C)
(PRCP):

(Seq ID No: 1256)

cctccttttcgccctcccaccccgcactgcagtctccagcctgagccatg

*Homo sapiens* proteolipid protein 1 (PLP1):

(Seq ID No: 1257)

aagccctttcatt
gcaggagaagaggacaaagatactcagagagaaaaagtaaaagaccgaa
gaaggaggctggagagaccaggatccttccagctgaacaaagtcagccacaaa
gcagactagccagccggctacaattggagtcagagtcccaaagacatg

*Homo sapiens* coiled-coil domain containing 80 (CCDC80):

(Seq ID No: 1258)

cagccttctcactcctcactgagtccactctgaacgtgctaaaatgg
gaaggaggcggtgttttgctgatctgttaaattcttagtgaagtttccttgatttccag
tggctgctgttgtttgagtttggtttggagcaaaactgaggtagtcctaacatttctgg
gactgaatccaggcaagagaaagaagaaaagaagaagaaaaagaggag
gaaaaaggtagggagaaataaagggaggagagaagcacagtgaaa
gaaaaaaaaagtcccttttcgacatcacattcctgtgtttccctcagcctg
gaaaacatattaatcccagtgcttttacgcccggaaacaaagagactaagccagac
tatgggggaaagggagataagaaggatcctggaactttaaagagggaaagagtgagat
tcagaaatcgccaggactggactttaagggacgtcctgtgtcagcacaagggactgg
cacacacagacacacgagaccgaggagaaactgcagacaaatgagatacaaagactta
gaaggacagctccttttcacctcatcctacttgtccagaaggtaaaaaga
cacagccagaaagaaaaggcatcggctcagctctcagatcaggacaggctgtg
gatctgtggcggtactctgaaagctggagctgcagcacaccccttt
gtattgctcaccctcggtaaagagagagagggctgggaggaaaagtagttcatctag
gaaactgtcctgggaaccaaacttctgatttcttttgcaaccctctgcattccatctc
tatgagccaccattggattacacaatg

*Homo sapiens* chromosome 20 open reading frame 44 (C20orf44):

(Seq ID No: 1259)

cgacctctttgcgcctgcgcccccccttgccagtctttcgccggcaaaaggaggac
gtagaaaaggggacaccggaaactcactcttcacccggaaatggttattgaggaacatg

*Homo sapiens* tryptophanyl tRNA synthetase 2, mitochondrial
(WARS2):

(Seq ID No: 1260)

cgcccttctcaagatg

*Homo sapiens* myotubularin related protein 2 (MTMR2):

(Seq ID No: 1261)

cttttccctgtgctgcccctgccgcgcgatggagaagagctcgagctgcgagagtcttggc
tcccagccggcggcggctcggccgcccagcgtggactccttgtccagttaatgtgttaag agccattgacatttgaagatcatcagaagtgaagataaaacatctcaaaaattataattg
cctccacttctcattcagagaattcagtgcatacaaaatcagcttctgttgtatcatcag
attccatttcaacttctgccgacaactttctcctgatttgaggagggagtctcgctcta
tccctaggctggagtgcattggcgccatctcggctcatttgcaacctctgtctcccggg
ttcaagcgattctcctgcctcagcttcccgaggagctgggattacaggtcctgagggagt
ctaacaagttagcagaaatg

*Homo sapiens* reticulon 3 (RTN3):

(Seq ID No: 1262)

cgccctctagctgcgctcggctgag
tcagtcagtctgtcggagtctgtcctcggagcaggcggagtaaagggactt
gagcgagccagttgccggattattctatttccctccctctctcccgccccg
tatctcttttcaccttctcccaccctcgctcgcgtagccatg

*Homo sapiens* G protein-coupled receptor 56 (GPR56):

(Seq ID No: 1263)

gtccctccctctccgcactagctgtctgccctgccctgccgtaggagatgggctgg
gagcctcccacgctctccagctcactcggcaggcagcggggaccagggctgg
caggttaagcctctgggggtggatcctgaaaggtggtccagccgcctggccctgcgtgg
gaccctccacctggcagcagacagggtctcgctctgtcacacaggctggagtgcag
tggtgtgatcttggctcatcgtaacctccacctcccgggttcaagtgat
tctcatgcctcagcctcccgagtagctgggattacaggtggtgacttccaagag
tgactccgtcggaggaaaatg

*Homo sapiens* immunoglobulin superfamily containing leucine-rich
repeat (ISLR):

(Seq ID No: 1264)

gctcctccctgccgcctcctctcagtg
gatggttccaggcaccctgtctggggcagggagggcacaggcctg
cacatcgaaggtggggtgggaccaggctgcccctcgccccagcatccaagtcctccctt
gggcgcccgtgccctgcagactctcagggctaaggtcctctgttgcttttt
ggttccaccttagaagaggctccgcttgactaagagtagcttgaaggaggcaccatg

*Homo sapiens* glycoprotein M6A (GPM6A):

(Seq ID No: 1265)

atttcttttcccattttaaatgcaaagcaagactt
gtgaatcatagtgtctctgctcctgggattcagac
caaatttccccccaaaattctcaggctatttgtttgaatacctgcttacagtgg
tacacaatgggcagctttgagaagaaaaattgataatcttcacggaagagtaattt
gaatgaaattacacttgacagcctgtctccaagcaaacaagaggaac
gagggagcctgagctaagctctgaggacttgcccaagccactgctgtt
ggagcttcccaggaaaaaaaaaaaaaaaaaaaaaaaaaaaaaaaaaaaaaaacaccag
tttttccaacatctaattgagcttttgattaattccgtgtaccagattctactgaa
gaaaggtagccatg

*Homo sapiens* splicing factor 1 (SF1):

(Seq ID No: 1266)

ctccctctttt
gtgcgtctcgcgccgccgccgcccgccgcgtgagaggacgggctccgcgcgctccgg
cagcgcattcgggtcccctcccccgggaggcttgcgaaggagaagccgccgcagag
gaaaagcaggtgccggtgcctgtccccggggcgccatg

*Homo sapiens* cell cycle associated protein 1 (CAPRIN1):

(Seq ID No: 1267)

ccgcccctcgcgacccagagggctgctggctggctaagtccctcccgctcccggctctcg
cctcactaggagcggctctcggtgcagcgggacagggcgaagcggcctgcgcccac
ggagcgcgcgacactgcccggaagggaccgccacccttgcccccctcagctgcccac
tcgtgatttccagcggcctccgcgcgcgcacgatg

*Homo sapiens* hypothetical protein FLJ90297 (LOC388152):

(Seq ID No: 1268)

ctgccctcttgcgtgccccggccaccccgggcggcttgtagccggtgcgcggggtggct
ggggctacgtgcagagctgtcgcggagccggaacagcagcggtgaagcccctcggctcgg
ccgagaccgccgtgcccattgctcgcctcggttgccgccgctttagccgcagccgctgct
gccgccgccggggagaggcagcctattgtctttctccgcggcgaaggtgaggagctgtc
tcggctcggcccgcgggggagcccgggagccgcacggagatggaggaggacatctggac
agtgagcaggaggcgcctcggcccatg

*Homo sapiens* kelch-like ECH-associated protein 1 (KEAP1):

(Seq ID No: 1269)

cgccctctccccgcctccttttcgggcgtcccgaggccgctccccaaccgacaaccaa
gaccccgcaggccacgcagccctggagccgaggcccccgacggcg
gaggcgcccgcgggtcccctacagccaaggtccctgagtgccagaggtggtggtgtt
gcttatcttctggaaccccatg

*Homo sapiens* F-box protein 38 (FBXO38):

(Seq ID No: 1270)

ctccctctcaaccacaa
taacaggcggagggtcggcgtaggtactttgaactcaagtaaacaaaagggaagat
tttctcgttgatactggagactgcacaacaatg

*Homo sapiens* musculoskeletal, embryonic nuclear protein 1 (MUSTN1):

(Seq ID No: 1271)

agatcttttccagcagctgctgcctgccagagaggcgccttcaga
gacccagcgcttacacaatacccaccatg

*Homo sapiens* QKI, KH domain containing, RNA binding (QKI):

(Seq ID No: 1272)

cctcctctccggcggcggcggcggcggcgggcggagtgagctgcggagcctg
gaatatg

*Homo sapiens* protein phosphatase 1, catalytic subunit, beta isoform (PPP1CB):

(Seq ID No: 1273)

gggcctctctt
gtttatttatttattttccgtgggtgcctccgagtgtgcgcgcgctctcgc
taccggcggggaggggtgggggagggcccgggaaaaggggggagtt
ggagccggggtcgaaacgccgcgtgacttgtaggtgagagaacgccgagccgtcgccg
cagcctccgccgccgagaagcccttgttcccgctgctgggaaggagag
tctgtgccgacaagatg

*Homo sapiens* methyltransferase like 21B (METTL21B):

(Seq ID No: 1274)

cagcctc
taccccgctccggatccgggatctgagcgccggccgcggtgcccaggcactccctt
ggcgggccggatg

*Homo sapiens* adaptor-related protein complex 3, mu 1 subunit (AP3M1):

(Seq ID No: 1275)

cggccttctcggcttctccagcttcggtaggagag
gatccggcgccgaatcactgactggcacaggtgttgggatagtgtctcactt
ggtcacccaggctggagtgcagtggcgcaatcttagctctc
tacagcgtcgatcttcctcctgggctcaagcaattctcctgcttcatcctcctgagtac
ctaggactacagaaaatg

*Homo sapiens* muscleblind-like splicing regulator 1 (MBNL1):

(Seq ID No: 1276)

cagtctttctcactgcagctgaatgagttgtggcgcccacaatgctcccatgacaaggagc
tgacaagttccatttccgtcgcgggcatcttggaatcatgactcccacaatgccttggg
cacttggtcgacagtggggccgcctctgaaaaaaaaatgtgagaggttggtactaagaag
tgcctttcctgacgtctctgctgcttggaaccgcttctagagcagtctctgcttttgcct
tgcttgctgccagctagactgtgacgacagcacatccaccctccacctctagcccagaca
cccccatttctacttataatcaagagaaaagctctaagtatctggcattgccctaggctg
ctttagtgttaaaagaaaagtttgctgaaaaagtaagatatcttctgccaggaaatcaag
gaggaaaaaaaaatcattttctcgattttgctctaaactgctgcatctgtctatgccaa
actaatcaataccgattgcaccaccaaactccattgcaaattcagctgtgaggagattcc
ctttcagacaactttgctgaaagcagcttggaaattcggtgtcgaagggtctgccacgtt
ttcatgcttgcattttgggctccaaattggcactgggaagggggttactgagagcacaagg
ctgataccaggccctacttttaaacgttcatctacttacaaatcctagtatttctctaaaa
accaaaacctctttgaattaacagtttcatgctgtgaatttctagtgggagatcttttcc
ttgatattgacgacacaattttccatgtacttttaaagcagggagtggggaaaagtattt
tgaggggacattttcatcatcagttcagctttttttttttggttgttgctctttttggg
ggggttgggtttgttggtttcactgaaacatttaactacctgtaaaatctaaacatg

*Homo sapiens* lipid phosphate phosphatase-related protein type 1 (LPPR1):

(Seq ID No: 1277)

cagccttttgctctttcctttcattaaacaaacaggagatcctgaaac
ctggaccctgtgcaagctgcagcgccaggaggaggcagcggaggaagcagagcgcgg
gatgggcgcccagcggcatctgtgatcccgcgcacctccgccccacgggcgcg
cacaaacacggacacacacatacacacactcgcgcacacactcgcacaaacacacac
tcgtacacgcccgccgctcgctcgccgcttgctctcccacgcaagcggaatgcag
cagcgcctggagagcgtgtctcggaccgccgcctgaatgtacctcgctcccgggagccg
gacggcccagtagggcgcactggaggacgctccgctgcgggagcctggacagttttt
gacggtgcagtcttgctatatggtgtgagaaatg

*Homo sapiens* muscleblind-like splicing regulator 2 (MBNL2):

(Seq ID No: 1278)

ctgtctttgcttcatcatctgaaggtaaaattttccagatacggcagac
ggctttcagagtacaataaacagggaatgagaac
tatttacatggaagtttctttctcatgatgcggtggagaagcctcggccactt
ggttctgccagatgttcctgggggttactgtaaatgg
gaaggacaggcagagctgcaaacaaggtttatcatttaaaagtgcctgtgtgaagtcac
ttttgctggaaaactgcagcttgggagctttctttgtattcacatcccac
tcttctgtcaagtacactttaccctgaccttatgagtggatgaagatacctcagtt
gtctgactttgccaattgcttaatttcagaatttaaaaaggggaaa
gaaaaacatcctgctaaaatatgaacatctgagtgtcttattttccaacatcgtcaa -continued tagctgtgagcgtcagcattaaatattctcccaaggagtgccatgatattgaagtcac
tttattaataacagctgtatctgcaaaacagtcaagagactcggacgttgaaagccaga
gatgacactgagcatgcttttattgcggcctaccatctttaagtgg
gacatattgattgatgagtgattgcctgtccatacactctctcatcatcctgttcctt
ggattggacttcactaagcaatttatcactcaccttcagacttacatgtgggag
ttttcacaacagtagttttggaatcattagaacttggattgat
ttcatcatttaacagaaacaaacagcccaaattactttatcaccatg Homo sapiens chromosome 3 open reading frame 25 (C3orf25):
(Seq ID No: 1279)

gcgcctttcgcacgacttggagttacggtttatctgataccgcggtaccccctacgcaa
gcaagcccacatcgacacacattcacacacgcccttcagcaccccctcccagcaccac
gaccatg Homo sapiens testis expressed 19 (TEX19):
(Seq ID No: 1280)

cctcctcctttccctgggtgcccacatgaacagagacaccaggatgctctcctgagacca
cagcaactgcagaagctgaagacatttccagaagttcaagcttccaccctctg
caggtccccactgagctgggacccaggtcatccaccccaccccaaatccctgga
taggaaaccctttctcctcctgctccttgtccccttcatccctgccgcccagcatcc
tactggcctcagcacctgtggccagaccgtccaagatcctctgaaggcccagctcttgct
gtccaccccggcagtaggcaggcagcctggccatg Homo sapiens protein kinase C, beta (PRKCB):
(Seq ID No: 1281)

gcctccctcccccg
cagctggggccagcggtgccaagcgcagctggacgagcggcagcagctgggcgag
tgacagccccggctccgcgcgccgcggccgccagagccggcgcaggggaa
gcgcccgcgccccgggtgcagcagcggccgccgcctcccgcgcctcccggcccg
cagcccgcggtcccgcggccccggggccggcacctctcgggctccggctccccgcgcg
caagatg Homo sapiens protein kinase N1 (PKN1):
(Seq ID No: 1282)

ccctccctccgcgcggg
gaccccctggcgggcggcaggaggacatg

Homo sapiens hemochromatosis type 2 (juvenile) (HFE2):
(Seq ID No: 1283)

ccttctctggttccctgacctcagtgagacagcagccggcctggggacctggggaga
cacggaggaccccctggctggagctgacccacagagtagggaatcatggctggagaatt
ggatagcagagtaatgtttgacctctggaaacatcac
ttacagggcttccggtcaaaattcactaggtaggagggtcatcagctgggaagaac
cggcgcctgggaaacctggctggataggtatg Homo sapiens ribosomal protein L9 (RPL9):
(Seq ID No: 1284)

cgttctttctttt
gctgcgtctactgcgagaatg

Homo sapiens ribosomal protein L3 (RPL3):
(Seq ID No: 1285)

cggcctcttcggcgg
gatttgatggcgtgatg

Homo sapiens ribosomal protein L4 (RPL4):
(Seq ID No: 1286)

acttccttttcctgtgg
cagcagccgggctgagaggagcgtggctgtctcctctctccgccatg

Homo sapiens ribosomal protein L5 (RPL5):
(Seq ID No: 1287)

tggcccttttcccaccccctagcgccgctgggcctgcaggtctctgtcgagcagcggac
gccggtctctgttccgcaggatg Homo sapiens ribosomal protein L6 (RPL6):
(Seq ID No: 1288)

aattctctttcccatcttgcaagatg

Homo sapiens ribosomal protein L7 (RPL7):
(Seq ID No: 1289)

cttcctcttttttccggctggaaccatg

Homo sapiens ribosomal protein L7a (RPL7A):
(Seq ID No: 1290)

ctttcctttctctctcctcccgccgcccaagatg

Homo sapiens ribosomal protein L11 (RPL11):
(Seq ID No: 1291)

ctttctcttcctgctctccatcatg

*Homo sapiens* ribosomal protein L12 (RPL12):

(Seq ID No: 1292)

cggcctctcggctttcggctcggaggaggccaaggtgcaacttccttcggtcgtcccgaa
tccggggttcatccgacaccagccgcctccaccatg

*Homo sapiens* ribosomal protein L13 (RPL13):

(Seq ID No: 1293)

gcttcctttccgctcggctgttttcctgcgcaggagccgcagggccgtaggcagccatg

*Homo sapiens* ribosomal protein L23 (RPL23):

(Seq ID No: 1294)

acttccttttttcttttttccggcgttcaagatg

*Homo sapiens* ribosomal protein L18 (RPL18):

(Seq ID No: 1295)

cgttctctctttccg
gacctggccgagcaggaggcgccatcatg

*Homo sapiens* ribosomal protein L18a (RPL18A):

(Seq ID No: 1296)

acttcctttt
gcgggtggcggcgaacgcggagagcacgccatg

*Homo sapiens* ribosomal protein L19 (RPL19):

(Seq ID No: 1297)

agctctttcctttcgctgctgcggccgcagccatg

*Homo sapiens* ribosomal protein L21 (RPL21):

(Seq ID No: 1298)

gcctctttcctttcggccggaaccgccatcttccagtaattcgccaaaatg

*Homo sapiens* ribosomal protein L22 (RPL22):

(Seq ID No: 1299)

ac
ctcccttttctaactccgctgccgccatg

*Homo sapiens* ribosomal protein L23a (RPL23A):

(Seq ID No: 1300)

agacccttttca
caagatg

*Homo sapiens* ribosomal protein L17 (RPL17):

(Seq ID No: 1301)

cgctcttcctctttccctaagcagcctgagggttgactg
gattggtgaggcccgtgtggctacttctgtggaagcagtgctgtagttactggaaga
taaaagggaaagcaagcccttggtgggggaaagtatggctgcgatgatgg
catttcttaggacacctttggattaataatgaaaacaactactctctgag
cagctgttcgaatcatctgatatttatactgaatgagttactgtaagtac
gtattgacagaattacactgtactttcctctaggtgatctgtgaaaatg

*Homo sapiens* ribosomal protein L24 (RPL24):

(Seq ID No: 1302)

ttctctctttctttttcgccatctttttgtctttccgtggagctgtcgccatg

*Homo sapiens* ribosomal protein L26 (RPL26):

(Seq ID No: 1303)

agttctcttcccttttgcggccatcaccgaagcgggagcggccaaaatg

*Homo sapiens* ribosomal protein L27 (RPL27):

(Seq ID No: 1304)

ctttcctttt
gctggtagggccgggtggttgctgccgaaatg

*Homo sapiens* ribosomal protein L30 (RPL30):

(Seq ID No: 1305)

aagtctttcctttctcgttccccggccatcttagcggctgctgttggtt
gggggccgtcccgctcctaaggcaggaagatg

*Homo sapiens* ribosomal protein L27a (RPL27A):

(Seq ID No: 1306)

ccttcctttttcgtctgggctgccaacatg

*Homo sapiens* ribosomal protein L28 (RPL28):

(Seq ID No: 1307)

cttcctctttccgtctcaggtcgccgctgcgaagggagccgccgccatg

*Homo sapiens* ribosomal protein L29 (RPL29):

(Seq ID No: 1308)

cagccccttctctcttccggttctaggcgcttcgggagccgcggcttatggtgcagacatg

*Homo sapiens* ribosomal protein L31 (RPL31):

(Seq ID No: 1309)

cgctcttcctttccaacttggacgctgcagaatg

*Homo sapiens* ribosomal protein L32 (RPL32):

(Seq ID No: 1310)

ccgtcccttctctcttcctcggcgctgcctacggaggtggcagccatctccttctcgg
catcatg

*Homo sapiens* ribosomal protein L35a (RPL35A):

(Seq ID No: 1311)

cgtccttctcttaccgccatcttggctcctgtggaggcctgctgggaacgg
gacttctaaaaggaactatg

*Homo sapiens* ribosomal protein L37 (RPL37):

(Seq ID No: 1312)

ccttctcttccggtctttctggtctcggccgcagaagcgagatg

*Homo sapiens* ribosomal protein L37a (RPL37A):

(Seq ID No: 1313)

gcgtctcttcctttctgggctcggacctaggtcgcggcgacatg

*Homo sapiens* ribosomal protein L38 (RPL38):

(Seq ID No: 1314)

cgttcttttttcgtccttttccccggttgctgcttgctgtgagtgtctctagggtgatac
gtgggtgagaaaggtcctggtccgcgccagagcccagcgcgcctcgtcgccatg

*Homo sapiens* ribosomal protein L39 (RPL39):

(Seq ID No: 1315)

ccctcctcttccttttctccgccatcgtggtgtgttcttgactccgctgctcgccatg

*Homo sapiens* ribosomal protein, large, P0 (RPLP0):

(Seq ID No: 1316)

ag
gcccttctctcgccaggcgtcctcgtggaagtgacatcgtctttaaaccctgcgtgg
caatccctgacgcaccgccgtgatg

*Homo sapiens* ribosomal protein, large, P1 (RPLP1):

(Seq ID No: 1317)

cggtccttccgaggaagctaaggctgcgttggggtgaggccctcac
ttcatccggcgactagcaccgcgtccggcagcgccagccctacactcgcccgcgccatg

*Homo sapiens* ribosomal protein, large, P2 (RPLP2):

(Seq ID No: 1318)

ccttccttttcctccctgtcgccaccgaggtcgcacgcgtgagacttctccgccgcctcc
gccgcagacgccgccgcgatg

*Homo sapiens* ribosomal protein S3 (RPS3):

(Seq ID No: 1319)

acttcctttcctttcagcggagcgcggcggcaagatg

*Homo sapiens* ribosomal protein S3A (RPS3A):

(Seq ID No: 1320)

ccgcccttt
ggctctctgaccagcaccatg

*Homo sapiens* ribosomal protein S4, X-linked (RPS4X):

(Seq ID No: 1321)

ggtcctcttttccttgcctaacgcagccatg

*Homo sapiens* ribosomal protein S4, Y-linked 1 (RPS4Y1):

(Seq ID No: 1322)

gat
tctcttccgtcgcagagtttcgccatg

*Homo sapiens* ribosomal protein S5 (RPS5):

(Seq ID No: 1323)

ttttcttcccag
ttaaaagtgttggcccgcggcgcgcggcctcttcctgtctgtac
cagggcggcgcgtggtctacgccgagtgacagagacgctcaggctgtgttctcaggatg

*Homo sapiens* ribosomal protein S6 (RPS6):

(Seq ID No: 1324)

ggccctcttttccgtggcgcctcggaggcgttcagctgcttcaagatg

*Homo sapiens* ribosomal protein S7 (RPS7):

(Seq ID No: 1325)

gggtctcttcctaa
gccggcgctcggcaagttctcccaggagaaagccatg

-continued

*Homo sapiens* ribosomal protein S8 (RPS8):

(Seq ID No: 1326)

gtttctctttccagccagcgccgagcgatg

*Homo sapiens* ribosomal protein S9 (RPS9):

(Seq ID No: 1327)

gcgcctctttctcag
tgaccgggtggtttgcttaggcgcagacggggaagcggagccaacatg

*Homo sapiens* ribosomal protein S10 (RPS10):

(Seq ID No: 1328)

gctccttcctttccagccccggtaccggaccctgcagccgcagagatg

*Homo sapiens* ribosomal protein S11 (RPS11):

(Seq ID No: 1329)

ctgccccttcttttttttcaggcggccgggaagatg

*Homo sapiens* ribosomal protein S12 (RPS12):

(Seq ID No: 1330)

ag
gcctctttccctgccgccgccgagtcgcgcggaggcggaggcttgggtgcgttcaagat
tcaacttcacccgtaacccaccgccatg

*Homo sapiens* ribosomal protein S13 (RPS13):

(Seq ID No: 1331)

cgctctcctttcgtt
gcctgatcgccgccatcatg

*Homo sapiens* ribosomal protein S15 (RPS15):

(Seq ID No: 1332)

cgatctcttctgag
gatccggcaagatg

*Homo sapiens* ribosomal protein S15a (RPS15A):

(Seq ID No: 1333)

cgtcctctcttccgccatctttccgcgccggtgagtagcactctctga
gagctccaatttcatccgtctgccatcggcgccatcctgcaatctaagccacaatg

*Homo sapiens* ribosomal protein S16 (RPS16):

(Seq ID No: 1334)

cttttcctttccggttgcggcgccgcgcggtgaggttgtctagtccacgctcggagc
catg

*Homo sapiens* ribosomal protein S19 (RPS19):

(Seq ID No: 1335)

cgttccctttcccctggctggcagcgcggaggccgcacgatg

*Homo sapiens* ribosomal protein S20 (RPS20):

(Seq ID No: 1336)

ccaccccttcttttttgaggaagacgcggtcgtaagggctgaggattttttggtccgcac
gctcctgctcctgactcaccgctgttcgctctcgccgaggaacaagtcggtcaggaa
gcccgcgcgcaacagccatg

*Homo sapiens* ribosomal protein S21 (RPS21):

(Seq ID No: 1337)

gcttcctttctctctcgcgcgcggtgtggtggcagcaggcgcagcccagcctcgaaatg

*Homo sapiens* ribosomal protein S23 (RPS23):

(Seq ID No: 1338)

gcttctctctttcgctcaggcccgtggcgccgacaggatg

*Homo sapiens* ribosomal protein S25 (RPS25):

(Seq ID No: 1339)

gcttccttttt
gtccgacatcttgacgaggctgcggtgtctgctgctattctccgagcttcgcaatg

*Homo sapiens* ribosomal protein S26 (RPS26):

(Seq ID No: 1340)

ccgtctcctctctccggtccgtgcctccaagatg

*Homo sapiens* ribosomal protein S27 (RPS27):

(Seq ID No: 1341)

cgctcctttccggcggtgacgacctacgcacacgagaacatg

*Homo sapiens* ribosomal protein S28 (RPS28):

(Seq ID No: 1342)

actcctctccgcca
gaccgccgccgcgccgccatcatg

-continued

*Homo sapiens* ribosomal protein S29 (RPS29):
(Seq ID No: 1343)
gcttcttccttttac
ctcgttgcactgctgagagcaagatg

*Homo sapiens* ribosomal protein L15 (RPL15):
(Seq ID No: 1344)
agctctttcctttccgtctggcggcagccatcaggtaagccaagatg

*Homo sapiens* ribosomal protein S2 (RPS2):
(Seq ID No: 1345)
cgttcttcttttccgacaaaacaccaaatg

*Homo sapiens* ribosomal protein L14 (RPL14):
(Seq ID No: 1346)
gggtcttcttccttctcgcctaacgccgccaacatg

*Homo sapiens* ribosomal protein S14 (RPS14):
(Seq ID No: 1347)
ctctctttccggtgtggagtctggagacgacgtgcagaaatg

*Homo sapiens* ribosomal protein L10 (RPL10):
(Seq ID No: 1348)
gcgcctctttcccttcggtgtgccactgaagatcctggtgtcgccatg

*Homo sapiens* ribosomal protein L10a (RPL10A):
(Seq ID No: 1349)
tag
tctcttttccggttagcgcggcgtgagaagccatg

*Homo sapiens* ribosomal protein L35 (RPL35):
(Seq ID No: 1350)
tcctctttccctcg
gagcgggcggcggcgttggcggcttgtgcagcaatg

*Homo sapiens* ribosomal protein L13a (RPL13A):
(Seq ID No: 1351)
cctcctccttttccaagcggctgccgaagatg

*Homo sapiens* ribosomal protein L36 (RPL36):
(Seq ID No: 1352)
cagcccttccgccac
ggccgtctctggagagcagcagccatg

*Homo sapiens* ribosomal protein L36a (RPL36A):
(Seq ID No: 1353)
gtttctttctttccgcgccgatagcgctcacgcaagcatg

*Homo sapiens* ribosomal protein L41 (RPL41):
(Seq ID No: 1354)
tcgcc tttctctcggccttagcgccattttttttggaaacctctgcgccatg

*Homo sapiens* ribosomal protein S18 (RPS18):
(Seq ID No: 1355)
cgctctctcttcca
caggaggcctacacgccgccgcttgtgctgcagccatg

*Homo sapiens* ribosomal protein S24 (RPS24):
(Seq ID No: 1356)
ggttctcttttcctccttggctgtctgaagatagatcgccatcatg

*Homo sapiens* ribosomal protein L8 (RPL8):
(Seq ID No: 1357)
tttcctctttcggccgcgctggtgaacaggtaggtcatccttgcggccttgcggcatg

*Homo sapiens* ribosomal protein L34 (RPL34):
(Seq ID No: 1358)
cttcctcttccggg
gacgttgtctgcaggtatg

*Homo sapiens* ribosomal protein S17 (RPS17):
(Seq ID No: 1359)
gtttcctcttttac
caaggacccgccaacatg

*Homo sapiens* ribosomal protein SA (RPSA):
(Seq ID No: 1360)
ctgtctttccgtgc
tacctgcagagggggtccatacggcgttgttctggattcccgtcg
taacttaaagggaaattttcacaatg

*Homo sapiens* eukaryotic translation initiation factor 3, subunit C (EIF3C):

(Seq ID No: 1361)

cttctctctcggcgtttccgctgtcagggccctgcggtgtgactcgcgggctcagctggt
ccggccgtagcacctccgcgccgtcgccatg

*Homo sapiens* poly(A) binding protein, cytoplasmic 1 (PABPC1):

(Seq ID No: 1362)

cgctctcctcctctcacggaaaggtcgcggcctgtggccctgcgggcag
ccgtgccgagatg

*Homo sapiens* tubulin, beta 1 class VI (TUBB1):

(Seq ID No: 1363)

cac
tcccttccaaaagcatgacaggcagaaagcagagaagggccag
gactggctgagggcggggagctgggcctctggggtggacacaccccttggtcacatt
gtgagggtagcttggttggccagtcccaccactgcagtgaccacagttgtgtt
gggctcacaccagtgaaccgaagctctggattctgagagtctgaggattccgtgaa
gatctcagacttgggctcagagcaaggatg PpLuc(GC)-ag-A64

(SEQ ID No: 1364)

GGGAGAAAGCTTGAGGATGGAGGACGCCAAGAACATCAAGAAGGGCCCGGCGCCCTTCTA
CCCGCTGGAGGACGGGACCGCCGGCGAGCAGCTCCACAAGGCCATGAAGCGGTACGCCCT
GGTGCCGGGCACGATCGCCTTCACCGACGCCCACATCGAGGTCGACATCACCTACGCGGA
GTACTTCGAGATGAGCGTGCGCCTGGCCGAGGCCATGAAGCGGTACGGCCTGAACACCAA
CCACCGGATCGTGGTGTGCTCGGAGAACAGCCTGCAGTTCTTCATGCCGGTGCTGGGCGC
CCTCTTCATCGGCGTGGCCGTCGCCCCGGCGAACGACATCTACAACGAGCGGGAGCTGCT
GAACAGCATGGGGATCAGCCAGCCGACCGTGGTGTTCGTGAGCAAGAAGGGCCTGCAGAA
GATCCTGAACGTGCAGAAGAAGCTGCCCATCATCCAGAAGATCATCATCATGGACAGCAA
GACCGACTACCAGGGCTTCCAGTCGATGTACACGTTCGTGACCAGCCACCTCCCGCCGGG
CTTCAACGAGTACGACTTCGTCCCGGAGAGCTTCGACCGGGACAAGACCATCGCCCTGAT
CATGAACAGCAGCGGCAGCACCGGCCTGCCGAAGGGGGTGGCCCTGCCGCACCGGACCGC
CTGCGTGCGCTTCTCGCACGCCCGGGACCCCATCTTCGGCAACCAGATCATCCCGGACAC
CGCCATCCTGAGCGTGGTGCCGTTCCACCACGGCTTCGGCATGTTCACGACCCTGGGCTA
CCTCATCTGCGGCTTCCGGGTGGTCCTGATGTACCGGTTCGAGGAGGAGCTGTTCCTGCG
GAGCCTGCAGGACTACAAGATCCAGAGCGCGCTGCTCGTGCCGACCCTGTTCAGCTTCTT
CGCCAAGAGCACCCTGATCGACAAGTACGACCTGTCGAACCTGCACGAGATCGCCAGCGG
GGGCGCCCCGCTGAGCAAGGAGGTGGGCGAGGCCGTGGCCAAGCGGTTCCACCTCCCGGG
CATCCGCCAGGGCTACGGCCTGACCGAGACCACGAGCGCGATCCTGATCACCCCCGAGGG
GGACGACAAGCCGGGCGCCGTGGGCAAGGTGGTCCCGTTCTTCGAGGCCAAGGTGGTGGA
CCTGGACACCGGCAAGACCCTGGGCGTGAACCAGCGGGGCGAGCTGTGCGTGCGGGGGCC
GATGATCATGAGCGGCTACGTGAACAACCCGGAGGCCACCAACGCCCTCATCGACAAGGA
CGGCTGGCTGCACAGCGGCGACATCGCCTACTGGGACGAGGACGAGCACTTCTTCATCGT
CGACCGGCTGAAGTCGCTGATCAAGTACAAGGGCTACCAGGTGGCGCCGGCCGAGCTGGA
GAGCATCCTGCTCCAGCACCCCAACATCTTCGACGCCGGCGTGGCCGGGCTGCCGGACGA
CGACGCCGGCGAGCTGCCGGCCGCGGTGGTGGTGCTGGAGCACGGCAAGACCATGACGGA
GAAGGAGATCGTCGACTACGTGGCCAGCCAGGTGACCACCGCCAAGAAGCTGCGGGGCGG
CGTGGTGTTCGTGGACGAGGTCCCGAAGGGCCTGACCGGGAAGCTCGACGCCCGGAAGAT
CCGCGAGATCCTGATCAAGGCCAAGAAGGGCGGCAAGATCGCCGTGTAAGACTAGTTATA
AGACTGACTAGCCCGATGGGCCTCCCAACGGGCCCTCCTCCCCTCCTTGCACCGAGATTA
ATAGATCTAAAAAAAAAAAAAAAAAAAAAAAAAAAAAAAAAAAAAAAAAAAAAAAAAAAA
AAAAAAAAAAA

RPL32-PpLuc(GC)-ag-A64-C30-histoneSL (SEQ ID No: 1365)

GGGGCGCTGCCTACGGAGGTGGCAGCCATCTCCTTCTCGGCATCAAGCTTGAGGATGGAG
GACGCCAAGAACATCAAGAAGGGCCCGGCGCCCTTCTACCCGCTGGAGGACGGGACCGCC
GGCGAGCAGCTCCACAAGGCCATGAAGCGGTACGCCCTGGTGCCGGGCACGATCGCCTTC
ACCGACGCCCACATCGAGGTCGACATCACCTACGCGGAGTACTTCGAGATGAGCGTGCGC
CTGGCCGAGGCCATGAAGCGGTACGGCCTGAACACCAACCACCGGATCGTGGTGTGCTCG
GAGAACAGCCTGCAGTTCTTCATGCCGGTGCTGGGCGCCCTCTTCATCGGCGTGGCCGTC
GCCCCGGCGAACGACATCTACAACGAGCGGGAGCTGCTGAACAGCATGGGGATCAGCCAG
CCGACCGTGGTGTTCGTGAGCAAGAAGGGCCTGCAGAAGATCCTGAACGTGCAGAAGAAG
CTGCCCATCATCCAGAAGATCATCATCATGGACAGCAAGACCGACTACCAGGGCTTCCAG
TCGATGTACACGTTCGTGACCAGCCACCTCCCGCCGGGCTTCAACGAGTACGACTTCGTC
CCGGAGAGCTTCGACCGGGACAAGACCATCGCCCTGATCATGAACAGCAGCGGCAGCACC
GGCCTGCCGAAGGGGGTGGCCCTGCCGCACCGGACCGCCTGCGTGCGCTTCTCGCACGCC
CGGGACCCCATCTTCGGCAACCAGATCATCCCGGACACCGCCATCCTGAGCGTGGTGCCG
TTCCACCACGGCTTCGGCATGTTCACGACCCTGGGCTACCTCATCTGCGGCTTCCGGGTG
GTCCTGATGTACCGGTTCGAGGAGGAGCTGTTCCTGCGGAGCCTGCAGGACTACAAGATC
CAGAGCGCGCTGCTCGTGCCGACCCTGTTCAGCTTCTTCGCCAAGAGCACCCTGATCGAC
AAGTACGACCTGTCGAACCTGCACGAGATCGCCAGCGGGGGCGCCCCGCTGAGCAAGGAG
GTGGGCGAGGCCGTGGCCAAGCGGTTCCACCTCCCGGGCATCCGCCAGGGCTACGGCCTG
ACCGAGACCACGAGCGCGATCCTGATCACCCCCGAGGGGGACGACAAGCCGGGCGCCGTG
GGCAAGGTGGTCCCGTTCTTCGAGGCCAAGGTGGTGGACCTGGACACCGGCAAGACCCTG
GGCGTGAACCAGCGGGGCGAGCTGTGCGTGCGGGGGCCGATGATCATGAGCGGCTACGTG
AACAACCCGGAGGCCACCAACGCCCTCATCGACAAGGACGGCTGGCTGCACAGCGGCGAC

```
-continued
ATCGCCTACTGGGACGAGGACGAGCACTTCTTCATCGTCGACCGGCTGAAGTCGCTGATC
AAGTACAAGGGCTACCAGGTGGCGCCGGCCGAGCTGGAGAGCATCCTGCTCCAGCACCCC
AACATCTTCGACGCCGGCGTGGCCGGGCTGCCGGACGACGACGCCGGCGAGCTGCCGGCC
GCGGTGGTGGTGCTGGAGCACGGCAAGACCATGACGGAGAAGGAGATCGTCGACTACGTG
GCCAGCCAGGTGACCACCGCCAAGAAGCTGCGGGGCGGCGTGGTGTTCGTGGACGAGGTC
CCGAAGGGCCTGACCGGGAAGCTCGACGCCCGGAAGATCCGCGAGATCCTGATCAAGGCC
AAGAAGGGCGGCAAGATCGCCGTGTAAGACTAGTTATAAGCTGACTAGCCCGATGGGCC
TCCCAACGGGCCCTCCTCCCCTCCTTGCACCGAGATTAATAGATCTAAAAAAAAAAAAAA
AAAAAAAAAAAAAAAAAAAAAAAAAAAAAAAAAAAAAAAAAAAAAAAAATGCATCCCCC
CCCCCCCCCCCCCCCCCCCCCCCCCAAAGGCTCTTTTCAGAGCCACCAGAATT
``` fragment of the 5'UTR of human ribosomal protein Large 32

(SEQ ID No: 1366)

```
ACGGAGGTGGCAGCCATCTCCTTCTCGGCATC
``` fragment of the 5'UTR of human ribosomal protein Large 32

(SEQ ID No: 1367)

```
GGCGCTGCCTACGGAGGTGGCAGCCATCTCCT
```

5'UTR of human ribosomal protein Large 32 lacking the 5' terminal oligopyrimidine tract (SEQ ID No. 1368)

```
GGCGCTGCCTACGGAGGTGGCAGCCATCTCCTTCTCGGCATC
```

Human albumin 3'UTR (SEQ ID No: 1369)

```
CATCACATTT AAAAGCATCT CAGCCTACCA TGAGAATAAG AGAAAGAAAA
TGAAGATCAA AAGCTTATTC ATCTGTTTTT CTTTTTCGTT GGTGTAAAGC
CAACACCCTG TCTAAAAAAC ATAAATTTCT TTAATCATTT TGCCTCTTTT
CTCTGTGCTT CAATTAATAA AAATGGAAA GAATCT
```

3'UTR of Homo sapiens hemoglobin, alpha 1 (HBA1)

(SEQ ID No: 1370)

```
gctggagcctcggtggccatgcttcttgcccctt
gggcctccccccagcccctcctcccccttcctgcacccgtaccccgtggtctttgaa
taaagtctgagtgggcggc
```

3'UTR of Homo sapiens hemoglobin, alpha 2 (HBA2)

(SEQ ID No: 1371)

```
gctggagcctcggtagccgttcctcctgcccgctgggcctcccaac
gggcccctcctcccctccttgcaccggcccttcctggtctttgaataaagtctgagtgggcag
```

3'UTR of Homo sapiens hemoglobin, beta (HBB)

(SEQ ID No: 1372)

```
Gctcgctttcttgctgtccaatttctattaaaggttcctttgttccctaagtccaactacta
aactgggggatattatgaagggccttgagcatctggattctgcctaa
taaaaaacatttattttcattgc
```

3'UTR of Homo sapiens tyrosine hydroxylase (TH)

(SEQ ID No: 1373)

```
gtgcacggcgtccctgagggcccttcccaacctcccctggtcctgcactgtcccg
gagctcaggccctggtgaggggctgggtcccgggtgccccccatgccctccctgctgcca
ggctcccactgcccctgcacctgcttctcagcg
caacagctgtgtgtgcccgtggtgaggtt
gtgctgcctgtggtgaggtcctgtcctggctcccagggtcctggggctgctgcac
tgccctccgcccttccctgacactgtctgctgccccaatcaccgtcacaataaaa
gaaactgtggtctcta
```

3'UTR of Homo sapiens arachidonate 15-lipoxygenase (ALOX15)

(SEQ ID No: 1374)

```
gcgtcgccacccttggttatttcagcccccatcacccaagccacaagctgaccccttcg
tggttatagccctgccctcccaagtcccaccctcttcccatgtcccaccctccctagagg
ggcacctttcatggtctctgcacccagtgaacacatttactctagaggcatcacctgg
gaccttactcctcttccttcctcctccttcctatcttcctcctctctcttcctc
tttcttcattcagatctatatggcaaatagccacaattatataatcatttcaagactag
aataggggatataatacatattactccacaccttttatgaatcaaatatgatttttttg
ttgttgttaagacagagtctcactttgacacccaggctggagtgcagtggtgccatcacc
acggctcactgcagcctcagcgtcctgggctcaaatgatcctcccacctcagcctcctga
gtagctgggactacaggctcatgccatcatgcccagctaatattttttttattttcgtgga
gacggggcctcactatgttgcctaggctggaaataggattttgaacccaaattgagttta
acaataataaaaagttgttttacgctaaagatggaaaagaactaggactgaactatttta
aataaaatattggc
```

3'UTR of Homo sapiens collagen, type I, alpha 1 (COL1A1)

(SEQ ID No: 1375)

```
actccctccatcccaacctggctccctcccacccaaccaactttcccccccaacccg
gaaacagacaagcaacccaaactgaaccccctcaaaagccaaaaaatgggaga
caatttcacatggactttggaaaatattttttttcctttgcattcatctctcaaacttag
ttttttatctttgaccaaccgaacatgaccaaaaaccaaaagtgcattcaaccttac
caaaaaaaaaaaaaaaaaagaataaataaataacttttttaaaaaaggaagctt
ggtccacttgcttgaagacccatgcgggggtaagtccccttttctgcccgtt
```

-continued

```
gggcttatgaaaccccaatgctgccctttctgctcctttctccacaccccctt
ggggcctcccctccactccttcccaaatctgtctccccagaagacacag
gaaacaatgtattgtctgcccag
caatcaaaggcaatgctcaaacacccaagtggcccccaccctcagcccgctcctgcccgc
ccagcacccccaggccctgggggacctggggttctcagactgccaaagaagcctt
gccatctggcgctcccatggctcttgcaacatctcccctttcgttttt
gagggggtcatgccgggggagccaccagcccctcactgggttcggaggagagtcag
gaagggccacgacaaagcagaaacatcggatttggggaacgcgtgtcaatcccttt
gtgccgcagggctgggcgggagagactgttctgttccttgtgtaactgtgttgctgaaa
gactacctcgttcttgtcttgatgtgtcaccggggcaactgcctgggggcggg
gatgggggcagggtggaagcggctccccatttttataccaaaggtgc
tacatctatgtgatgggtgggtggggagggaatcactggtgctatagaaattga
gatgcccocccaggccagcaaatgttccttttttgttcaaagtctattttttattccttga
tattttctttttttttttttttttgtggatgggactt
gtgaattttctaaaggtgctatttaacatgggagga
gagcgtgtgcggctccagcccagcccgctgctcacttttccaccctctctccac
ctgcctctggcttctcaggcctctgctctccgac
ctctctcctctgaaaccctcctccacagctgcagcccatctcccggctccctcctag
tctgtcctgcgtcctctgtccccgggtttcagagacaacttcccaaagcacaaagcag
tttttcccctaggggtgggaggaagcaaaagactctgtacctattttgtatgtg
tataataatttgagatgttttaattattttgattgctggaataaagcatgtg
gaaatgacccaaacataa
``` albumin7 3′ UTR (SEQ ID No: 1376)

```
CATCACATTTAAAAGCATCTCAGCCTACCATGAGAATAAGAGAAAGAAAATGAA
GATCAATAGCTTATTCATCTCTTTTTCTTTTTCGTTGGTGTAAA
GCCAACACCCTGTCTAAAAAACATAAATTTCTTTAATCATTTT
GCCTCTTTTCTCTGTGCTTCAATTAATAAAAAATGGAAAGAACCT
```

Human albumin 3′UTR + poly(A) sequence (SEQ ID No: 1377)

```
CATCACATTT AAAAGCATCT CAGCCTACCA TGAGAATAAG AGAAAGAAAA TGAA
GATCAA AAGCTTATTC ATCTGTTTTT CTTTTTCGTT GGTGTAAAGC
CAACACCCTG TCTAAAAAAC ATAAATTTCT TTAATCATTT TGCCTCTTTT
CTCTGTGCTT CAATTAATAA AAAATGGAAA GAATCTAGAT CTAAAAAAAA
AAAAAAAAAA AAAAAAAAAA AAAAAAAAAA AAAAAAAAAA AAAAAAAAAA
AAAAAA
```

Human albumin 3′UTR fragment 1

(SEQ ID No: 1378)

```
AAAAGCATCT CAGCCTACCA TGAGAATAAG AGAAAGAAAA TGAAGATCAA AA
GCTTATTC ATCTGTTTTT CTTTTTCGTT GGTGTAAAGC CAACACCCTG
TCTAAAAAAC ATAAATTTCT TTAATCATTT TGCCTCTTTT CTCTGTGCTT CAATT
```

Human albumin 3′UTR fragment 2

(SEQ ID No: 1379)

```
CATCACATTT AAAAGCATCT CAGCCTACCA TGAGAATAAG AGAAAGAAAA
TGAAGATCAA AAGCTTATTC ATCTGTTTTT CTTTTTCGTT GGTGTAAAGC
CAACACCCTG
```

Human albumin 3′UTR fragment 3

(SEQ ID No: 1380)

```
AAAAGCATCT CAGCCTACCA TGAGAATAAG AGAAAGAAAA TGAAGATCAA
AAGCTTATTC ATCTGTTTTT CTTTTTCGTT GGTGTAAAGC CAACACCCTG
TCTAAAAAAC
```

Human albumin 3′UTR fragment 4

(SEQ ID No: 1381)

```
CAGCCTACCA TGAGAATAAG AGAAAGAAAA TGAAGATCAA AAGCTTATTC
ATCTGTTTTT CTTTTTCGTT GGTGTAAAGC CAACACCCTG TCTAAAAAAC
ATAAATTTCT
```

Human albumin 3′UTR fragment 5

(SEQ ID No: 1382)

```
TGAGAATAAG AGAAAGAAAA TGAAGATCAA AAGCTTATTC ATCTGTTTTT
CTTTTTCGTT GGTGTAAAGC CAACACCCTG TCTAAAAAAC ATAAATTTCT
TTAATCATTT
```

Human albumin 3′UTR fragment 6

(SEQ ID No: 1383)

```
AGAAAGAAAA TGAAGATCAA AAGCTTATTC ATCTGTTTTT CTTTTTCGTT
GGTGTAAAGC CAACACCCTG TCTAAAAAAC ATAAATTTCT TTAATCATTT
TGCCTCTTTT
```

Human albumin 3′UTR fragment 7

(SEQ ID No: 1384)

```
TGAAGATCAA AAGCTTATTC ATCTGTTTTT CTTTTTCGTT GGTGTAAAGC
CAACACCCTG TCTAAAAAAC ATAAATTTCT TTAATCATTT TGCCTCTTTT
CTCTGTGCTT
```

-continued

Human albumin 3'UTR fragment 8
(SEQ ID No: 1385)
AAGCTTATTC ATCTGTTTTT CTTTTTCGTT GGTGTAAAGC CAACACCCTG
TCTAAAAAAC ATAAATTTCT TTAATCATTT TGCCTCTTTT CTCTGTGCTT
CAATTAATAA Human albumin 3'UTR fragment 9
(SEQ ID No: 1386)
ATCTGTTTTT CTTTTTCGTT GGTGTAAAGC CAACACCCTG TCTAAAAAAC
ATAAATTTCT TTAATCATTT TGCCTCTTTT CTCTGTGCTT CAATTAATAA
AAAATGGAAA Human albumin 3'UTR fragment 10
(SEQ ID No: 1387)
CAGCCTACCA TGAGAATAAG AGAAAGAAAA TGAAGATCAA AAGCTTATTC
ATCTGTTTTT CTTTTTCGTT GGTGTAAAGC CAACACCCTG TCTAAAAAAC
ATAAATTTCT TTAATCATTT TGCCTCTTTT CTCTGTGCTT CAATTAATAA A Human albumin 3'UTR fragment 11
(SEQ ID No: 1388)
TGAAGATCAA AAGCTTATTC ATCTGTTTTT CTTTTTCGTT GGTGTAAAGC
CAACACCCTG TCTAAAAAAC ATAAATTTCT TTAATCATTT TGCCTCTTTT
CTCTGTGCTT CAATTAATAA A Human albumin 3'UTR fragment 12
(SEQ ID No: 1389)
CTTTTTCGTT GGTGTAAAGC CAACACCCTG TCTAAAAAAC ATAAATTTCT
TTAATCATTT TGCCTCTTTT CTCTGTGCTT CAATTAATAA A Human albumin 3'UTR fragment 13
(SEQ ID No: 1390)
AAGCTTATTC ATCTGTTTTT CTTTTTCGTT GGTGTAAAGC CAACACCCTG
TCTAAAAAAC Sequence according to formula (Ic)
(SEQ ID NO: 1391)
NGNNNNNNUNNNNNCN Sequence according to formula (IIc):
(SEQ ID NO: 1392)
N*N*NNNNGNNNNNNUNNNNNCNNNN*N*N*

Sequence according to formula (Id):
(SEQ ID NO: 1393)
NCNNNNNNUNNNNNGN

Sequence according to formula (IId)
(SEQ ID NO: 1394)
N*N*NNNNCNNNNNNUNNNNNGNNNN*N*N*

Sequence according to formula (Ie)
(SEQ ID NO: 1395)
DGNNNNNNUNNNNNCH

Sequence according to formula (IIe)
(SEQ ID NO: 1396)
N*N*NNNDGNNNNNNUNNNNNCHNNN*N*N*

Sequence according to formula (If)
(SEQ ID NO: 1397)
NGNBYYNNUNVNDNCN

Sequence according to formula (IIf)
(SEQ ID NO: 1398)
N*N*NNNNGNBYYNNUNVNDNCNNNN*N*N*

Sequence according to formula (Ig)
(SEQ ID NO: 1399)
NGHYYYDNUHABRDCN

Sequence according to formula (IIg)
(SEQ ID NO: 1400)
N*N*HNNNGHYYYDNUHABRDCNNNN*N*H*

Sequence according to formula (Ih)
(SEQ ID NO: 1401)
DGHYCUDYUHASRRCC

Sequence according to formula (IIh)
(SEQ ID NO: 1402)
N*H*AAHDGHYCUDYUHASRRCCVHB*N*H*

-continued

Sequence according to formula (Ic)  
VGYYYYHHTHRVVRCB  
(SEQ ID NO: 1403)

Sequence according to formula (Ic)  
SGYYYTTYTMARRRCS  
(SEQ ID NO: 1404)

Sequence according to formula (Ic)  
SGYYCTTTTMAGRRCS  
(SEQ ID NO: 1405)

Sequence according to formula (Ie)  
DGNNNBNNTHVNNNCH  
(SEQ ID NO: 1406)

Sequence according to formula (Ie)  
RGNNNYHBTHRDNNCY  
(SEQ ID NO: 1407)

Sequence according to formula (Ie)  
RGNDBYHYTHRDHNCY  
(SEQ ID NO: 1408)

Sequence according to formula (If)  
VGYYYTYHTHRVRRCB  
(SEQ ID NO: 1409)

Sequence according to formula (If)  
SGYYCTTYTMAGRRCS  
(SEQ ID NO: 1410)

Sequence according to formula (If)  
SGYYCTTTTMAGRRCS  
(SEQ ID NO: 1411)

Sequence according to formula (Ig)  
GGYYCTTYTHAGRRCC  
(SEQ ID NO: 1412)

Sequence according to formula (Ig)  
GGCYCTTYTMAGRGCC  
(SEQ ID NO: 1413)

Sequence according to formula (Ig)  
GGCTCTTTTMAGRGCC  
(SEQ ID NO: 1414)

Sequence according to formula (Ih)  
DGHYCTDYTHASRRCC  
(SEQ ID NO: 1415)

Sequence according to formula (Ih)  
GGCYCTTTTHAGRGCC  
(SEQ ID NO: 1416)

Sequence according to formula (Ih)  
GGCYCTTTTMAGRGCC  
(SEQ ID NO: 1417)

Sequence according to formula (IIc)  
H*H*HHVVGYYYYHHTHRVVRCBVHH*N*N*  
(SEQ ID NO: 1418)

Sequence according to formula (IIc)  
M*H*MHMSGYYYTTYTMARRRCSMCH*H*H*  
(SEQ ID NO: 1419)

Sequence according to formula (IIc)  
M*M*MMMSGYYCTTTTMAGRRCSACH*M*H*  
(SEQ ID NO: 1420)

Sequence according to formula (IIe)  
N*N*NNNDGNNNBNNTHVNNNCHNHN*N*N*  
(SEQ ID NO: 1421)

Sequence according to formula (IIe)  
N*N*HHNRGNNNYHBTHRDNNCYDHH*N*N*  
(SEQ ID NO: 1422)

Sequence according to formula (IIe)
(SEQ ID NO: 1423)
N*H*HHVRGNDBYHYTHRDHNCYRHH*H*H*

Sequence according to formula (IIf)
(SEQ ID NO: 1424)
H*H*MHMVGYYYTYHTHRVRRCBVMH*H*N*

Sequence according to formula (IIf)
(SEQ ID NO: 1425)
M*M*MMMSGYYCTTYTMAGRRCSMCH*H*H*

Sequence according to formula (IIf)
(SEQ ID NO: 1426)
M*M*MMMSGYYCTTTTMAGRRCSACH*M*H*

Sequence according to formula (IIg)
(SEQ ID NO: 1427)
H*H*MAMGGYYCTTYTHAGRRCCVHN*N*M*

Sequence according to formula (IIg)
(SEQ ID NO: 1428)
H*H*AAMGGCYCTTYTMAGRGCCVCH*H*M*

Sequence according to formula (IIg)
(SEQ ID NO: 1429)
M*M*AAMGGCTCTTTTMAGRGCCMCY*M*M*

Sequence according to formula (IIh)
(SEQ ID NO: 1430)
N*H*AAHDGHYCTDYTHASRRCCVHB*N*H*

Sequence according to formula (IIh)
(SEQ ID NO: 1431)
H*H*AAMGGCYCTTTTHAGRGCCVMY*N*M*

Sequence according to formula (IIh)
(SEQ ID NO: 1432)
H*M*AAAGGCYCTTTTMAGRGCCRMY*H*M*

Specific histone stem-loop sequence
(SEQ ID NO: 1433)
CAAAGGCTCTTTTCAGAGCCACCA

Center, α-complex-binding portion of the 3'UTR of an α-globin gene
(SEQ ID NO: 1434)
GCCCGATGGGCCTCCCAACGGGCCCTCCTCCCCTCCTTGCACCG ATP synthase lipid-binding protein, mitochondrial (atp5g2)
(SEQ ID NO: 1435)
tagttt ctcctctcga acgccaggtg gagcaaccgg ccggataccg ccacagccct ggcaggcggc gctgtgatg RPL35-PpLuc(GC)-albumin7-A64-C30-histoneSL
(SEQ ID NO: 1436)
GGGGAGCGGGCGGCGGCGTTGGCGGCTTGTGCAGCAAAGCTTGAGGATGGAGGACGCCAA
GAACATCAAGAAGGGCCCGGCGCCCTTCTACCCGCTGGAGGACGGGACCGCCGGCGAGCA
GCTCCACAAGGCCATGAAGCGGTACGCCCTGGTGCCGGGCACGATCGCCTTCACCGACGC
CCACATCGAGGTCGACATCACCTACGCGGAGTACTTCGAGATGAGCGTGCGCCTGGCCGA
GGCCATGAAGCGGTACGGCCTGAACACCAACCACCGGATCGTGGTGTGCTCGGAGAACAG
CCTGCAGTTCTTCATGCCGGTGCTGGGCGCCCTCTTCATCGGCGTGGCCGTCGCCCCGGC
GAACGACATCTACAACGAGCGGGAGCTGCTGAACAGCATGGGGATCAGCCAGCCGACCGT
GGTGTTCGTGAGCAAGAAGGGCCTGCAGAAGATCCTGAACGTGCAGAAGAAGCTGCCCAT
CATCCAGAAGATCATCATCATGGACAGCAAGACCGACTACCAGGGCTTCCAGTCGATGTA
CACGTTCGTGACCAGCCACCTCCCGCCGGGCTTCAACGAGTACGACTTCGTCCCGGAGAG
CTTCGACCGGGACAAGACCATCGCCCTGATCATGAACAGCAGCGGCAGCACCGGCCTGCC
GAAGGGGGTGGCCCTGCCGCACCGGACCGCCTGCGTGCGCTTCTCGCACGCCCGGGACCC
CATCTTCGGCAACCAGATCATCCCGGACACCGCCATCCTGAGCGTGGTGCCGTTCCACCA
CGGCTTCGGCATGTTCACGACCCTGGGCTACCTCATCTGCGGCTTCCGGGTGGTCCTGAT
GTACCGGTTCGAGGAGGAGCTGTTCCTGCGGAGCCTGCAGGACTACAAGATCCAGAGCGC
GCTGCTCGTGCCGACCCTGTTCAGCTTCTTCGCCAAGAGCACCCTGATCGACAAGTACGA
CCTGTCGAACCTGCACGAGATCGCCAGCGGGGGCGCCCCGCTGAGCAAGGAGGTGGGCGA
GGCCGTGGCCAAGCGGTTCCACCTCCCGGGCATCCGCCAGGGCTACGGCCTGACCGAGAC
CACGAGCGCGATCCTGATCACCCCCGAGGGGGACGACAAGCCGGGCGCCGTGGGCAAGGT
GGTCCCGTTCTTCGAGGCCAAGGTGGTGGACCTGGACACCGGCAAGACCCTGGGCGTGAA
CCAGCGGGGCGAGCTGTGCGTGCGGGGGCCGATGATCATGAGCGGCTACGTGAACAACCC
GGAGGCCACCAACGCCCTCATCGACAAGGACGGCTGGCTGCACAGCGGCGACATCGCCTA
CTGGGACGAGGACGAGCACTTCTTCATCGTCGACCGGCTGAAGTCGCTGATCAAGTACAA
GGGCTACCAGGTGGCGCCGGCCGAGCTGGAGAGCATCCTGCTCCAGCACCCCAACATCTT
CGACGCCGGCGTGGCCGGGCTGCCGGACGACGACGCCGGCGAGCTGCCGGCCGCGGTGGT

```
GGTGCTGGAGCACGGCAAGACCATGACGGAGAAGGAGATCGTCGACTACGTGGCCAGCCA
GGTGACCACCGCCAAGAAGCTGCGGGGCGGCGTGGTGTTCGTGGACGAGGTCCCGAAGGG
CCTGACCGGGAAGCTCGACGCCCGGAAGATCCGCGAGATCCTGATCAAGGCCAAGAAGGG
CGGCAAGATCGCCGTGTAAGACTAGTGCATCACATTTAAAAGCATCTCAGCCTACCATGA
GAATAAGAGAAAGAAAATGAAGATCAATAGCTTATTCATCTCTTTTTCTTTTTCGTTGGT
GTAAAGCCAACACCCTGTCTAAAAAACATAAATTTCTTTAATCATTTTGCCTCTTTTCTC
TGTGCTTCAATTAATAAAAAATGGAAAGAACCTAGATCTAAAAAAAAAAAAAAAAAAAA
AAAAAAAAAAAAAAAAAAAAAAAAAAAAAAAAAAAAAAAAAAAATGCATCCCCCCCCCCC
CCCCCCCCCCCCCCCCCCAAAGGCTCTTTTCAGAGCCACCAGAATT
```

RPL21-PpLuc(GC)-albumin7-A64-C30-histoneSL (SEQ ID NO: 1437)

```
GGGGCCGGAACCGCCATCTTCCAGTAATTCGCCAAAAAGCTTGAGGATGGAGGACGCCAA
GAACATCAAGAAGGGCCCGGCGCCCTTCTACCCGCTGGAGGACGGGACCGCCGGCGAGCA
GCTCCACAAGGCCATGAAGCGGTACGCCCTGGTGCCGGGCACGATCGCCTTCACCGACGC
CCACATCGAGGTCGACATCACCTACGCGGAGTACTTCGAGATGAGCGTGCGCCTGGCCGA
GGCCATGAAGCGGTACGGCCTGAACACCAACCACCGGATCGTGGTGTGCTCGGAGAACAG
CCTGCAGTTCTTCATGCCGGTGCTGGGCGCCCTCTTCATCGGCGTGGCCGTCGCCCCGGC
GAACGACATCTACAACGAGCGGGAGCTGCTGAACAGCATGGGGATCAGCCAGCCGACCGT
GGTGTTCGTGAGCAAGAAGGGCCTGCAGAAGATCCTGAACGTGCAGAAGAAGCTGCCCAT
CATCCAGAAGATCATCATCATGGACAGCAAGACCGACTACCAGGGCTTCCAGTCGATGTA
CACGTTCGTGACCAGCCACCTCCCGCCGGGCTTCAACGAGTACGACTTCGTCCCGGAGAG
CTTCGACCGGGACAAGACCATCGCCCTGATCATGAACAGCAGCGGCAGCACCGGCCTGCC
GAAGGGGGTGGCCCTGCCGCACCGGACCGCCTGCGTGCGCTTCTCGCACGCCCGGGACCC
CATCTTCGGCAACCAGATCATCCCGGACACCGCCATCCTGAGCGTGGTGCCGTTCCACCA
CGGCTTCGGCATGTTCACGACCCTGGGCTACCTCATCTGCGGCTTCCGGGTGGTCCTGAT
GTACCGGTTCGAGGAGGAGCTGTTCCTGCGGAGCCTGCAGGACTACAAGATCCAGAGCGC
GCTGCTCGTGCCGACCCTGTTCAGCTTCTTCGCCAAGAGCACCCTGATCGACAAGTACGA
CCTGTCGAACCTGCACGAGATCGCCAGCGGGGCGCCCCGCTGAGCAAGGAGGTGGGCGA
GGCCGTGGCCAAGCGGTTCCACCTCCCGGGCATCCGCCAGGGCTACGGCCTGACCGAGAC
CACGAGCGCGATCCTGATCACCCCCGAGGGGGACGACAAGCCGGGCGCCGTGGGCAAGGT
GGTCCCGTTCTTCGAGGCCAAGGTGGTGGACCTGGACACCGGCAAGACCCTGGGCGTGAA
CCAGCGGGGCGAGCTGTGCGTGCGGGGGCCGATGATCATGAGCGGCTACGTGAACAACCC
GGAGGCCACCAACGCCCTCATCGACAAGGACGGCTGGCTGCACAGCGGCGACATCGCCTA
CTGGGACGAGGACGAGCACTTCTTCATCGTCGACCGGCTGAAGTCGCTGATCAAGTACAA
GGGCTACCAGGTGGCGCCGGCCGAGCTGGAGAGCATCCTGCTCCAGCACCCCAACATCTT
CGACGCCGGCGTGGCCGGGCTGCCGGACGACGACGCCGGCGAGCTGCCGGCCGCGGTGGT
GGTGCTGGAGCACGGCAAGACCATGACGGAGAAGGAGATCGTCGACTACGTGGCCAGCCA
GGTGACCACCGCCAAGAAGCTGCGGGGCGGCGTGGTGTTCGTGGACGAGGTCCCGAAGGG
CCTGACCGGGAAGCTCGACGCCCGGAAGATCCGCGAGATCCTGATCAAGGCCAAGAAGGG
CGGCAAGATCGCCGTGTAAGACTAGTGCATCACATTTAAAAGCATCTCAGCCTACCATGA
GAATAAGAGAAAGAAAATGAAGATCAATAGCTTATTCATCTCTTTTTCTTTTTCGTTGGT
GTAAAGCCAACACCCTGTCTAAAAAACATAAATTTCTTTAATCATTTTGCCTCTTTTCTC
TGTGCTTCAATTAATAAAAAATGGAAAGAACCTAGATCTAAAAAAAAAAAAAAAAAAAA
AAAAAAAAAAAAAAAAAAAAAAAAAAAAAAAAAAAAAAAAAAAATGCATCCCCCCCCCCC
CCCCCCCCCCCCCCCCCCAAAGGCTCTTTTCAGAGCCACCAGAATT
```

ATP5A1-PpLuc(GC)-albumin7-A64-C30-histoneSL (SEQ ID NO: 1438)

```
GGGCGGCTCGGCCATTTTGTCCCAGTCAGTCCGGAGGCTGCGGCTGCAGAAGTACCGCCT
GCGGAGTAACTGCAAAGAAGCTTGAGGATGGAGGACGCCAAGAACATCAAGAAGGGCCCG
GCGCCCTTCTACCCGCTGGAGGACGGGACCGCCGGCGAGCAGCTCCACAAGGCCATGAAG
CGGTACGCCCTGGTGCCGGGCACGATCGCCTTCACCGACGCCCACATCGAGGTCGACATC
ACCTACGCGGAGTACTTCGAGATGAGCGTGCGCCTGGCCGAGGCCATGAAGCGGTACGGC
CTGAACACCAACCACCGGATCGTGGTGTGCTCGGAGAACAGCCTGCAGTTCTTCATGCCG
GTGCTGGGCGCCCTCTTCATCGGCGTGGCCGTCGCCCCGGCGAACGACATCTACAACGAG
CGGGAGCTGCTGAACAGCATGGGGATCAGCCAGCCGACCGTGGTGTTCGTGAGCAAGAAG
GGCCTGCAGAAGATCCTGAACGTGCAGAAGAAGCTGCCCATCATCCAGAAGATCATCATC
ATGGACAGCAAGACCGACTACCAGGGCTTCCAGTCGATGTACACGTTCGTGACCAGCCAC
CTCCCGCCGGGCTTCAACGAGTACGACTTCGTCCCGGAGAGCTTCGACCGGGACAAGACC
ATCGCCCTGATCATGAACAGCAGCGGCAGCACCGGCCTGCCGAAGGGGGTGGCCCTGCCG
CACCGGACCGCCTGCGTGCGCTTCTCGCACGCCCGGGACCCCATCTTCGGCAACCAGATC
ATCCCGGACACCGCCATCCTGAGCGTGGTGCCGTTCCACCACGGCTTCGGCATGTTCACG
ACCCTGGGCTACCTCATCTGCGGCTTCCGGGTGGTCCTGATGTACCGGTTCGAGGAGGAG
CTGTTCCTGCGGAGCCTGCAGGACTACAAGATCCAGAGCGCGCTGCTCGTGCCGACCCTG
TTCAGCTTCTTCGCCAAGAGCACCCTGATCGACAAGTACGACCTGTCGAACCTGCACGAG
ATCGCCAGCGGGGCGCCCCGCTGAGCAAGGAGGTGGGCGAGGCCGTGGCCAAGCGGTTC
CACCTCCCGGGCATCCGCCAGGGCTACGGCCTGACCGAGACGCGATCCTGATC
ACCCCCGAGGGGGACGACAAGCCGGGCGCCGTGGGCAAGGTGGTCCCGTTCTTCGAGGCC
AAGGTGGTGGACCTGGACACCGGCAAGACCCTGGGCGTGAACCAGCGGGGCGAGCTGTGC
GTGCGGGGGCCGATGATCATGAGCGGCTACGTGAACAACCCGGAGGCCACCAACGCCCTC
ATCGACAAGGACGGCTGGCTGCACAGCGGCGACATCGCCTACTGGGACGAGGACGAGCAC
TTCTTCATCGTCGACCGGCTGAAGTCGCTGATCAAGTACAAGGGCTACCAGGTGGCGCCG
GCCGAGCTGGAGAGCATCCTGCTCCAGCACCCCAACATCTTCGACGCCGGCGTGGCCGGG
CTGCCGGACGACGACGCCGGCGAGCTGCCGGCCGCGGTGGTGGTGCTGGAGCACGGCAAG
ACCATGACGGAGAAGGAGATCGTCGACTACGTGGCCAGCCAGGTGACCACCGCCAAGAAG
CTGCGGGGCGGCGTGGTGTTCGTGGACGAGGTCCCGAAGGGCCTGACCGGGAAGCTCGAC
GCCCGGAAGATCCGCGAGATCCTGATCAAGGCCAAGAAGGGCGGCAAGATCGCCGTGTAA
GACTAGTGCATCACATTTAAAAGCATCTCAGCCTACCATGAGAATAAGAGAAAGAAAATG
AAGATCAATAGCTTATTCATCTCTTTTTCTTTTTCGTTGGTGTAAAGCCAACACCCTGTC
TAAAAAACATAAATTTCTTTAATCATTTTGCCTCTTTTCTCTGTGCTTCAATTAATAAAA
```

```
AATGGAAAGAACCTAGATCTAAAAAAAAAAAAAAAAAAAAAAAAAAAAAAAAAAAAAAAA
AAAAAAAAAAAAAAAAAAAAAAAATGCATCCCCCCCCCCCCCCCCCCCCCCCCCCCCCC
AAAGGCTCTTTTCAGAGCCACCAGAATT
```

HSD17B4-PpLuc(GC)-albumin7-A64-C30-histoneSL  (SEQ ID NO: 1439)

```
GGGTCCCGCAGTCGGCGTCCAGCGGCTCTGCTTGTTCGTGTGTGTGTCGTTGCAGGCCTT
ATTCAAGCTTGAGGATGGAGGACGCCAAGAACATCAAGAAGGGCCCGGCGCCCTTCTACC
CGCTGGAGGACGGGACCGCCGGCGAGCAGCTCCACAAGGCCATGAAGCGGTACGCCCTGG
TGCCGGGCACGATCGCCTTCACCGACGCCCACATCGAGGTCGACATCACCTACGCGGAGT
ACTTCGAGATGAGCGTGCGCCTGGCCGAGGCCATGAAGCGGTACGGCCTGAACACCAACC
ACCGGATCGTGGTGTGCTCGGAGAACAGCCTGCAGTTCTTCATGCCGGTGCTGGGCGCCC
TCTTCATCGGCGTGGCCGTCGCCCCGGCGAACGACATCTACAACGAGCGGGAGCTGCTGA
ACAGCATGGGGATCAGCCAGCCGACCGTGGTGTTCGTGAGCAAGAAGGGCCTGCAGAAGA
TCCTGAACGTGCAGAAGAAGCTGCCCATCATCCAGAAGATCATCATCATGGACAGCAAGA
CCGACTACCAGGGCTTCCAGTCGATGTACACGTTCGTGACCAGCCACCTCCCGCCGGGCT
TCAACGAGTACGACTTCGTCCCGGAGAGCTTCGACCGGGACAAGACCATCGCCCTGATCA
TGAACAGCAGCGGCAGCACCGGCCTGCCGAAGGGGGTGGCCCTGCCGCACCGGACCGCCT
GCGTGCGCTTCTCGCACGCCCGGGACCCCATCTTCGGCAACCAGATCATCCCGGACACCG
CCATCCTGAGCGTGGTGCCGTTCCACCACGGCTTCGGCATGTTCACGACCCTGGGCTACC
TCATCTGCGGCTTCCGGGTGGTCCTGATGTACCGGTTCGAGGAGGAGCTGTTCCTGCGGA
GCCTGCAGGACTACAAGATCCAGAGCGCGCTGCTCGTGCCGACCCTGTTCAGCTTCCG
CCAAGAGCACCCTGATCGACAAGTACGACCTGTCGAACCTGCACGAGATCGCCAGCGGGG
GCGCCCCGCTGAGCAAGGAGGTGGGCGAGGCCGTGGCCAAGCGGTTCCACCTCCCGGGCA
TCCGCCAGGGCTACGGCCTGACCGAGACCACGAGCGCGATCCTGATCACCCCCGAGGGGG
ACGACAAGCCGGGCGCCGTGGGCAAGGTGGTCCCGTTCTTCGAGGCCAAGGTGGTGGACC
TGGACACCGGCAAGACCCTGGGCGTGAACCAGCGGGGCGAGCTGTGCGTGCGGGGGCCGA
TGATCATGAGCGGCTACGTGAACAACCCGGAGGCCACCAACGCCCTCATCGACAAGGACG
GCTGGCTGCACAGCGGCGACATCGCCTACTGGGACGAGGACGAGCACTTCTTCATCGTCG
ACCGGCTGAAGTCGCTGATCAAGTACAAGGGCTACCAGGTGGCGCCGGCCGAGCTGGAGA
GCATCCTGCTCCAGCACCCCAACATCTTCGACGCCGGCGTGGCCGGGCTGCCGGACGACG
ACGCCGGCGAGCTGCCGGCCGCGGTGGTGGTGCTGGAGCACGGCAAGACCATGACGGAGA
AGGAGATCGTCGACTACGTGGCCAGCCAGGTGACCACCGCCAAGAAGCTGCGGGGCGGCG
TGGTGTTCGTGGACGAGGTCCCGAAGGGCCTGACCGGGAAGCTCGACGCCCGGAAGATCC
GCGAGATCCTGATCAAGGCCAAGAAGGGCGGCAAGATCGCCGTGTAAGACTAGTGCATCA
CATTTAAAAGCATCTCAGCCTACCATGAGAATAAGAGAAGAAAGAAAATGAAGATCAATAGCT
TATTCATCTCTTTTTCTTTTTCGTTGGTGTAAAGCCAACACCCTGTCTAAAAAACATAAA
TTTCTTTAATCATTTTGCCTCTTTTCTCTGTGCTTCAATTAATAAAAAATGGAAAGAACC
TAGATCTAAAAAAAAAAAAAAAAAAAAAAAAAAAAAAAAAAAAAAAAAAAAAAAAAAAAA
AAAAAAAAAAATGCATCCCCCCCCCCCCCCCCCCCCCCCCCCCCCAAAGGCTCTTTTC
AGAGCCACCAGAATT
```

AIG1-PpLuc(GC)-albumin7-A64-C30-histoneSL  (SEQ ID NO: 1440)

```
GGGCCGCCCAGCCGGTCCAGGCCTCTGGCGAACAAGCTTGAGGATGGAGGACGCCAAGAA
CATCAAGAAGGGCCCGGCGCCCTTCTACCCGCTGGAGGACGGGACCGCCGGCGAGCAGCT
CCACAAGGCCATGAAGCGGTACGCCCTGGTGCCGGGCACGATCGCCTTCACCGACGCCCA
CATCGAGGTCGACATCACCTACGCGGAGTACTTCGAGATGAGCGTGCGCCTGGCCGAGGC
CATGAAGCGGTACGGCCTGAACACCAACCACCGGATCGTGGTGTGCTCGGAGAACAGCCT
GCAGTTCTTCATGCCGGTGCTGGGCGCCCTCTTCATCGGCGTGGCCGTCGCCCCGGCGAA
CGACATCTACAACGAGCGGGAGCTGCTGAACAGCATGGGGATCAGCCAGCCGACCGTGGT
GTTCGTGAGCAAGAAGGGCCTGCAGAAGATCCTGAACGTGCAGAAGAAGCTGCCCATCAT
CCAGAAGATCATCATCATGGACAGCAAGACCGACTACCAGGGCTTCCAGTCGATGTACAC
GTTCGTGACCAGCCACCTCCCGCCGGGCTTCAACGAGTACGACTTCGTCCCGGAGAGCTT
CGACCGGGACAAGACCATCGCCCTGATCATGAACAGCAGCGGCAGCACCGGCCTGCCGAA
GGGGGTGGCCCTGCCGCACCGGACCGCCTGCGTGCGCTTCTCGCACGCCCGGGACCCCAT
CTTCGGCAACCAGATCATCCCGGACACCGCCATCCTGAGCGTGGTGCCGTTCCACCACGG
CTTCGGCATGTTCACGACCCTGGGCTACCTCATCTGCGGCTTCCGGGTGGTCCTGATGTA
CCGGTTCGAGGAGGAGCTGTTCCTGCGGAGCCTGCAGGACTACAAGATCCAGAGCGCGCT
GCTCGTGCCGACCCTGTTCAGCTTCTTCGCCAAGAGCACCCTGATCGACAAGTACGACCT
GTCGAACCTGCACGAGATCGCCAGCGGGGCGCCCCGCTGAGCAAGGAGGTGGGCGAGGC
CGTGGCCAAGCGGTTCCACCTCCCGGGCATCCGCCAGGGCTACGGCCTGACCGAGACCAC
GAGCGCGATCCTGATCACCCCCGAGGGGGACGACAAGCCGGGCGCCGTGGGCAAGGTGGT
CCCGTTCTTCGAGGCCAAGGTGGTGGACCTGGACACCGGCAAGACCCTGGGCGTGAACCA
GCGGGGCGAGCTGTGCGTGCGGGGGCCGATGATCATGAGCGGCTACGTGAACAACCCGGA
GGCCACCAACGCCCTCATCGACAAGGACGGCTGGCTGCACAGCGGCGACATCGCCTACTG
GGACGAGGACGAGCACTTCTTCATCGTCGACCGGCTGAAGTCGCTGATCAAGTACAAGGG
CTACCAGGTGGCGCCGGCCGAGCTGGAGAGCATCCTGCTCCAGCACCCCAACATCTTCGA
CGCCGGCGTGGCCGGGCTGCCGGACGACGACGCCGGCGAGCTGCCGGCCGCGGTGGTGGT
GCTGGAGCACGGCAAGACCATGACGGAGAAGGAGATCGTCGACTACGTGGCCAGCCAGGT
GACCACCGCCAAGAAGCTGCGGGGCGGCGTGGTGTTCGTGGACGAGGTCCCGAAGGGCCT
GACCGGGAAGCTCGACGCCCGGAAGATCCGCGAGATCCTGATCAAGGCCAAGAAGGGCGG
CAAGATCGCCGTGTAAGACTAGTGCATCACATTTAAAAGCATCTCAGCCTACCATGAGAA
TAAGAGAAGAAAATGAAGATCAATAGCTTATTCATCTCTTTTTCTTTTTCGTTGGTGTA
AAGCCAACACCCTGTCTAAAAAACATAAATTTCTTTAATCATTTTGCCTCTTTTCTCTGT
GCTTCAATTAATAAAAAATGGAAAGAACCTAGATCTAAAAAAAAAAAAAAAAAAAAAAAA
AAAAAAAAAAAAAAAAAAAAAAAAAAAAAAAAAAATGCATCCCCCCCCCCCCCCCCC
CCCCCCCCCCCCCCCAAAGGCTCTTTTCAGAGCCACCAGAATT
```

-continued

COX6C-PpLuc(GC)-albumin7-A64-C30-histoneSL (SEQ ID NO: 1441)

GGAGTCAGGAAGGACGTTGGTGTTGAGGTTAGCATACGTATCAAGGACAGTAACTACCAA
GCTTGAGGATGGAGGACGCCAAGAACATCAAGAAGGGCCCGGCGCCCTTCTACCCGCTGG
AGGACGGGACCGCCGGCGAGCAGCTCCACAAGGCCATGAAGCGGTACGCCCTGGTGCCGG
GCACGATCGCCTTCACCGACGCCCACATCGAGGTCGACATCACCTACGCGGAGTACTTCG
AGATGAGCGTGCGCCTGGCCGAGGCCATGAAGCGGTACGGCCTGAACACCAACCACCGGA
TCGTGGTGTGCTCGGAGAACAGCCTGCAGTTCTTCATGCCGGTGCTGGGCGCCCTCTTCA
TCGGCGTGGCCGTCGCCCCGGCGAACGACATCTACAACGAGCGGGAGCTGCTGAACAGCA
TGGGGATCAGCCAGCCGACCGTGGTGTTCGTGAGCAAGAAGGGCCTGCAGAAGATCCTGA
ACGTGCAGAAGAAGCTGCCCATCATCCAGAAGATCATCATCATGGACAGCAAGACCGACT
ACCAGGGCTTCCAGTCGATGTACACGTTCGTGACCAGCCACCTCCCGCCGGGCTTCAACG
AGTACGACTTCGTCCCGGAGAGCTTCGACCGGGACAAGACCATCGCCCTGATCATGAACA
GCAGCGGCAGCACCGGCCTGCCGAAGGGGGTGGCCCTGCCGCACCGGACCGCCTGCGTGC
GCTTCTCGCACGCCCGGGACCCCATCTTCGGCAACCAGATCATCCCGGACACCGCCATCC
TGAGCGTGGTGCCGTTCCACCACGGCTTCGGCATGTTCACGACCCTGGGCTACCTCATCT
GCGGCTTCCGGGTGGTCCTGATGTACCGGTTCGAGGAGGAGCTGTTCCTGCGGAGCCTGC
AGGACTACAAGATCCAGAGCGCGCTGCTCGTGCCGACCCTGTTCAGCTTCTTCGCCAAGA
GCACCCTGATCGACAAGTACGACCTGTCGAACCTGCACGAGATCGCCAGCGGGGCGCCC
CGCTGAGCAAGGAGGTGGGCGAGGCCGTGGCCAAGCGGTTCCACCTCCCGGGCATCCGCC
AGGGCTACGGCCTGACCGAGACCACGAGCGCGATCCTGATCACCCCCGAGGGGGACGACA
AGCCGGGCGCCGTGGGCAAGGTGGTCCCGTTCTTCGAGGCCAAGGTGGTGGACCTGGACA
CCGGCAAGACCCTGGGCGTGAACCAGCGGGGCGAGCTGTGCGTGCGGGGGCCGATGATCA
TGAGCGGCTACGTGAACAACCCGGAGGCCACCAACGCCCTCATCGACAAGGACGGCTGGC
TGCACAGCGGCGACATCGCCTACTGGGACGAGGACGAGCACTTCTTCATCGTCGACCGGC
TGAAGTCGCTGATCAAGTACAAGGGCTACCAGGTGGCGCCGGCCGAGCTGGAGAGCATCC
TGCTCCAGCACCCCAACATCTTCGACGCCGGCGTGGCCGGGCTGCCGGACGACGACGCCG
GCGAGCTGCCGGCCGCGGTGGTGGTGCTGGAGCACGGCAAGACCATGACGGAGAAGGAGA
TCGTCGACTACGTGGCCAGCCAGGTGACCACCGCCAAGAAGCTGCGGGGCGGCGTGGTGT
TCGTGGACGAGGTCCCGAAGGGCCTGACCGGGAAGCTCGACGCCCGGAAGATCCGCGAGA
TCCTGATCAAGGCCAAGAAGGGCGGCAAGATCGCCGTGTAAGACTAGTGCATCACATTTA
AAAGCATCTCAGCCTACCATGAGAATAAGAGAAAGAAAATGAAGATCAATAGCTTATTCA
TCTCTTTTTCTTTTTCGTTGGTGTAAAGCCAACACCCTGTCTAAAAAACATAAATTTCTT
TAATCATTTTGCCTCTTTTCTCTGTGCTTCAATTAATAAAAAATGGAAAGAACCTAGATC
TAAAAAAAAAAAAAAAAAAAAAAAAAAAAAAAAAAAAAAAAAAAAAAAAAAAAAAAAAAA
AAAAATGCATCCCCCCCCCCCCCCCCCCCCCCCCCCCCCCCAAAGGCTCTTTTCAGAGCC
ACCAGAATT

ASAH1-PpLuc(GC)-albumin7-A64-C30-histoneSL (SEQ ID NO: 1442)

GGGCCTCTGCTGGAGTCCGGGGAGTGGCGTTGGCTGCTAGAGCGAAGCTTGAGGATGGAG
GACGCCAAGAACATCAAGAAGGGCCCGGCGCCCTTCTACCCGCTGGAGGACGGGACCGCC
GGCGAGCAGCTCCACAAGGCCATGAAGCGGTACGCCCTGGTGCCGGGCACGATCGCCTTC
ACCGACGCCCACATCGAGGTCGACATCACCTACGCGGAGTACTTCGAGATGAGCGTGCGC
CTGGCCGAGGCCATGAAGCGGTACGGCCTGAACACCAACCACCGGATCGTGGTGTGCTCG
GAGAACAGCCTGCAGTTCTTCATGCCGGTGCTGGGCGCCCTCTTCATCGGCGTGGCCGTC
GCCCCGGCGAACGACATCTACAACGAGCGGGAGCTGCTGAACAGCATGGGGATCAGCCAG
CCGACCGTGGTGTTCGTGAGCAAGAAGGGCCTGCAGAAGATCCTGAACGTGCAGAAGAAG
CTGCCCATCATCCAGAAGATCATCATCATGGACAGCAAGACCGACTACCAGGGCTTCCAG
TCGATGTACACGTTCGTGACCAGCCACCTCCCGCCGGGCTTCAACGAGTACGACTTCGTC
CCGGAGAGCTTCGACCGGGACAAGACCATCGCCCTGATCATGAACAGCAGCGGCAGCACC
GGCCTGCCGAAGGGGGTGGCCCTGCCGCACCGGACCGCCTGCGTGCGCTTCTCGCACGCC
CGGGACCCCATCTTCGGCAACCAGATCATCCCGGACACCGCCATCCTGAGCGTGGTGCCG
TTCCACCACGGCTTCGGCATGTTCACGACCCTGGGCTACCTCATCTGCGGCTTCCGGGTG
GTCCTGATGTACCGGTTCGAGGAGGAGCTGTTCCTGCGGAGCCTGCAGGACTACAAGATC
CAGAGCGCGCTGCTCGTGCCGACCCTGTTCAGCTTCTTCGCCAAGAGCACCCTGATCGAC
AAGTACGACCTGTCGAACCTGCACGAGATCGCCAGCGGGGCGCCCCGCTGAGCAAGGAG
GTGGGCGAGGCCGTGGCCAAGCGGTTCCACCTCCCGGGCATCCGCCAGGGCTACGGCCTG
ACCGAGACCACGAGCGCGATCCTGATCACCCCCGAGGGGGACGACAAGCCGGGCGCCGTG
GGCAAGGTGGTCCCGTTCTTCGAGGCCAAGGTGGTGGACCTGGACACCGGCAAGACCCTG
GGCGTGAACCAGCGGGGCGAGCTGTGCGTGCGGGGGCCGATGATCATGAGCGGCTACGTG
AACAACCCGGAGGCCACCAACGCCCTCATCGACAAGGACGGCTGGCTGCACAGCGGCGAC
ATCGCCTACTGGGACGAGGACGAGCACTTCTTCATCGTCGACCGGCTGAAGTCGCTGATC
AAGTACAAGGGCTACCAGGTGGCGCCGGCCGAGCTGGAGAGCATCCTGCTCCAGCACCCC
AACATCTTCGACGCCGGCGTGGCCGGGCTGCCGGACGACGACGCCGGCGAGCTGCCGGCC
GCGGTGGTGGTGCTGGAGCACGGCAAGACCATGACGGAGAAGGAGATCGTCGACTACGTG
GCCAGCCAGGTGACCACCGCCAAGAAGCTGCGGGGCGGCGTGGTGTTCGTGGACGAGGTC
CCGAAGGGCCTGACCGGGAAGCTCGACGCCCGGAAGATCCGCGAGATCCTGATCAAGGCC
AAGAAGGGCGGCAAGATCGCCGTGTAAGACTAGTGCATCACATTTAAAAGCATCTCAGCC
TACCATGAGAATAAGAGAAAGAAAATGAAGATCAATAGCTTATTCATCTCTTTTTCTTTT
TCGTTGGTGTAAAGCCAACACCCTGTCTAAAAAACATAAATTTCTTTAATCATTTTGCCT
CTTTTCTCTGTGCTTCAATTAATAAAAAATGGAAAGAACCTAGATCTAAAAAAAAAAAAA
AAAAAAAAAAAAAAAAAAAAAAAAAAAAAAAAAAAAAAAAAAAAAAATGCATCCCC
CCCCCCCCCCCCCCCCCCCCCCCCAAAGGCTCTTTTCAGAGCCACCAGAATT mRPL21-PpLuc(GC)-albumin7-A64-C30-histoneSL (SEQ ID NO: 1443)

GGGGCCGCCGCAGCCATCTTCCAGTAACTCGCCAAAAAGCTTGAGGATGGAGGACGCCAA
GAACATCAAGAAGGGCCCGGCGCCCTTCTACCCGCTGGAGGACGGGACCGCCGGCGAGCA
GCTCCACAAGGCCATGAAGCGGTACGCCCTGGTGCCGGGCACGATCGCCTTCACCGACGC

-continued

```
CCACATCGAGGTCGACATCACCTACGCGGAGTACTTCGAGATGAGCGTGCGCCTGGCCGA
GGCCATGAAGCGGTACGGCCTGAACACCAACCACCGGATCGTGGTGTGCTCGGAGAACAG
CCTGCAGTTCTTCATGCCGGTGCTGGGCGCCCTCTTCATCGGCGTGGCCGTCGCCCCGGC
GAACGACATCTACAACGAGCGGGAGCTGCTGAACAGCATGGGGATCAGCCAGCCGACCGT
GGTGTTCGTGAGCAAGAAGGGCCTGCAGAAGATCCTGAACGTGCAGAAGAAGCTGCCCAT
CATCCAGAAGATCATCATCATGGACAGCAAGACCGACTACCAGGGCTTCCAGTCGATGTA
CACGTTCGTGACCAGCCACCTCCCGCCGGGCTTCAACGAGTACGACTTCGTCCCCGGAGAG
CTTCGACCGGGACAAGACCATCGCCCTGATCATGAACAGCAGCGGCAGCACCGGCCTGCC
GAAGGGGGTGGCCCTGCCGCACCGGACCGCCTGCGTGCGCTTCTCGCACGCCCGGGACCC
CATCTTCGGCAACCAGATCATCCCGGACACCGCCATCCTGAGCGTGGTGCCGTTCCACCA
CGGCTTCGGCATGTTCACGACCCTGGGCTACCTCATCTGCGGCTTCCGGGTGGTCCTGAT
GTACCGGTTCGAGGAGGAGCTGTTCCTGCGGAGCCTGCAGGACTACAAGATCCAGAGCGC
GCTGCTCGTGCCGACCCTGTTCAGCTTCTTCGCCAAGAGCACCCTGATCGACAAGTACGA
CCTGTCGAACCTGCACGAGATCGCCAGCGGGGGCGCCCCGCTGAGCAAGGAGGTGGGCGA
GGCCGTGGCCAAGCGGTTCCACCTCCCGGGCATCCGCCAGGGCTACGGCCTGACCGAGAC
CACGAGCGCGATCCTGATCACCCCCGAGGGGGACGACAAGCCGGGCGCCGTGGGCAAGGT
GGTCCCGTTCTTCGAGGCCAAGGTGGTGGACCTGGACACCGGCAAGACCCTGGGCGTGAA
CCAGCGGGGCGAGCTGTGCGTGCGGGGGCCGATGATCATGAGCGGCTACGTGAACAACCC
GGAGGCCACCAACGCCCTCATCGACAAGGACGGCTGGCTGCACAGCGGCGACATCGCCTA
CTGGGACGAGGACGAGCACTTCTTCATCGTCGACCGGCTGAAGTCGCTGATCAAGTACAA
GGGCTACCAGGTGGCGCCGGCCGAGCTGGAGAGCATCCTGCTCCAGCACCCCAACATCTT
CGACGCCGGCGTGGCCGGGCTGCCGGACGACGACGCCGGCGAGCTGCCGGCCGCGGTGGT
GGTGCTGGAGCACGGCAAGACCATGACGGAGAAGGAGATCGTCGACTACGTGGCCAGCCA
GGTGACCACCGCCAAGAAGCTGCGGGGCGGCGTGGTGTTCGTGGACGAGGTCCCGAAGGG
CCTGACCGGGAAGCTCGACGCCCGGAAGATCCGCGAGATCCTGATCAAGGCCAAGAAGGG
CGGCAAGATCGCCGTGTAAGACTAGTGCATCACATTTAAAAGCATCTCAGCCTACCATGA
GAATAAGAGAAAGAAAATGAAGATCAATAGCTTATTCATCTCTTTTTCTTTTTCGTTGGT
GTAAAGCCAACACCCTGTCTAAAAAACATAAATTTCTTTAATCATTTTGCCTCTTTTCTC
TGTGCTTCAATTAATAAAAAATGGAAAGAACCTAGATCTAAAAAAAAAAAAAAAAAAAAA
AAAAAAAAAAAAAAAAAAAAAAAAAAAAAAAAAAAAAAAAATGCATCCCCCCCCCCCC
CCCCCCCCCCCCCCCCCCAAAGGCTCTTTTCAGAGCCACCAGAATT
``` mRPL35A-PpLuc(GC)-albumin7-A64-C30-histoneSL (SEQ ID NO: 1444)

```
GGGCCATCTTGGCGCCTGTGGAGGCCTGCTGGGAACAGGACTTCTAACAGCAAGTAAGCT
TGAGGATGGAGGACGCCAAGAACATCAAGAAGGGCCCGGCGCCCTTCTACCCGCTGGAGG
ACGGGACCGCCGGCGAGCAGCTCCACAAGGCCATGAAGCGGTACGCCCTGGTGCCGGGCA
CGATCGCCTTCACCGACGCCCACATCGAGGTCGACATCACCTACGCGGAGTACTTCGAGA
TGAGCGTGCGCCTGGCCGAGGCCATGAAGCGGTACGGCCTGAACACCAACCACCGGATCG
TGGTGTGCTCGGAGAACAGCCTGCAGTTCTTCATGCCGGTGCTGGGCGCCCTCTTCATCG
GCGTGGCCGTCGCCCCGGCGAACGACATCTACAACGAGCGGGAGCTGCTGAACAGCATGG
GGATCAGCCAGCCGACCGTGGTGTTCGTGAGCAAGAAGGGCCTGCAGAAGATCCTGAACG
TGCAGAAGAAGCTGCCCATCATCCAGAAGATCATCATCATGGACAGCAAGACCGACTACC
AGGGCTTCCAGTCGATGTACACGTTCGTGACCAGCCACCTCCCGCCGGGCTTCAACGAGT
ACGACTTCGTCCCGGAGAGCTTCGACCGGGACAAGACCATCGCCCTGATCATGAACAGCA
GCGGCAGCACCGGCCTGCCGAAGGGGGTGGCCCTGCCGCACCGGACCGCCTGCGTGCGCT
TCTCGCACGCCCGGGACCCCATCTTCGGCAACCAGATCATCCCGGACACCGCCATCCTGA
GCGTGGTGCCGTTCCACCACGGCTTCGGCATGTTCACGACCCTGGGCTACCTCATCTGCG
GCTTCCGGGTGGTCCTGATGTACCGGTTCGAGGAGGAGCTGTTCCTGCGGAGCCTGCAGG
ACTACAAGATCCAGAGCGCGCTGCTCGTGCCGACCCTGTTCAGCTTCTTCGCCAAGAGCA
CCCTGATCGACAAGTACGACCTGTCGAACCTGCACGAGATCGCCAGCGGGGGCGCCCCGC
TGAGCAAGGAGGTGGGCGAGGCCGTGGCCAAGCGGTTCCACCTCCCGGGCATCCGCCAGG
GCTACGGCCTGACCGAGACCACGAGCGCGATCCTGATCACCCCCGAGGGGGACGACAAGC
CGGGCGCCGTGGGCAAGGTGGTCCCGTTCTTCGAGGCCAAGGTGGTGGACCTGGACACCG
GCAAGACCCTGGGCGTGAACCAGCGGGGCGAGCTGTGCGTGCGGGGGCCGATGATCATGA
GCGGCTACGTGAACAACCCGGAGGCCACCAACGCCCTCATCGACAAGGACGGCTGGCTGC
ACAGCGGCGACATCGCCTACTGGGACGAGGACGAGCACTTCTTCATCGTCGACCGGCTGA
AGTCGCTGATCAAGTACAAGGGCTACCAGGTGGCGCCGGCCGAGCTGGAGAGCATCCTGC
TCCAGCACCCCAACATCTTCGACGCCGGCGTGGCCGGGCTGCCGGACGACGACGCCGGCG
AGCTGCCGGCCGCGGTGGTGGTGCTGGAGCACGGCAAGACCATGACGGAGAAGGAGATCG
TCGACTACGTGGCCAGCCAGGTGACCACCGCCAAGAAGCTGCGGGGCGGCGTGGTGTTCG
TGGACGAGGTCCCGAAGGGCCTGACCGGGAAGCTCGACGCCCGGAAGATCCGCGAGATCC
TGATCAAGGCCAAGAAGGGCGGCAAGATCGCCGTGTAAGACTAGTGCATCACATTTAAAA
GCATCTCAGCCTACCATGAGAATAAGAGAAAGAAAATGAAGATCAATAGCTTATTCATCT
CTTTTTCTTTTTCGTTGGTGTAAAGCCAACACCCTGTCTAAAAAACATAAATTTCTTTAA
TCATTTTGCCTCTTTTCTCTGTGCTTCAATTAATAAAAAATGGAAAGAACCTAGATCTAA
AAAAAAAAAAAAAAAAAAAAAAAAAAAAAAAAAAAAAAAAAAAAAAAAAAAAAAAAAAAA
AATGCATCCCCCCCCCCCCCCCCCCCCCCCCCCCCCAAAGGCTCTTTTCAGAGCCACC
AGAATT
```

RPL35-PpLuc(GC)-A64-C30-histoneSL (SEQ ID NO: 1445)

```
GGGGAGCGGGCGGCGGCGTTGGCGGCTTGTGCAGCAAAGCTTGAGGATGGAGGACGCCAA
GAACATCAAGAAGGGCCCGGCGCCCTTCTACCCGCTGGAGGACGGGACCGCCGGCGAGCA
GCTCCACAAGGCCATGAAGCGGTACGCCCTGGTGCCGGGCACGATCGCCTTCACCGACGC
CCACATCGAGGTCGACATCACCTACGCGGAGTACTTCGAGATGAGCGTGCGCCTGGCCGA
GGCCATGAAGCGGTACGGCCTGAACACCAACCACCGGATCGTGGTGTGCTCGGAGAACAG
CCTGCAGTTCTTCATGCCGGTGCTGGGCGCCCTCTTCATCGGCGTGGCCGTCGCCCCGGC
GAACGACATCTACAACGAGCGGGAGCTGCTGAACAGCATGGGGATCAGCCAGCCGACCGT
GGTGTTCGTGAGCAAGAAGGGCCTGCAGAAGATCCTGAACGTGCAGAAGAAGCTGCCCAT
CATCCAGAAGATCATCATCATGGACAGCAAGACCGACTACCAGGGCTTCCAGTCGATGTA
```

-continued

```
CACGTTCGTGACCAGCCACCTCCCGCCGGGCTTCAACGAGTACGACTTCGTCCCGGAGAG
CTTCGACCGGGACAAGACCATCGCCCTGATCATGAACAGCAGCGGCAGCACCGGCCTGCC
GAAGGGGGTGGCCCTGCCGCACCGGACCGCCTGCGTGCGCTTCTCGCACGCCCGGGACCC
CATCTTCGGCAACCAGATCATCCCGGACACCGCCATCCTGAGCGTGGTGCCGTTCCACCA
CGGCTTCGGCATGTTCACGACCCTGGGCTACCTCATCTGCGGCTTCCGGGTGGTCCTGAT
GTACCGGTTCGAGGAGGAGCTGTTCCTGCGGAGCCTGCAGGACTACAAGATCCAGAGCGC
GCTGCTCGTGCCGACCCTGTTCAGCTTCTTCGCCAAGAGCACCCTGATCGACAAGTACGA
CCTGTCGAACCTGCACGAGATCGCCAGCGGGGCGCCCCGCTGAGCAAGGAGGTGGGCGA
GGCCGTGGCCAAGCGGTTCCACCTCCCGGGCATCCGCCAGGGCTACGGCCTGACCGAGAC
CACGAGCGCGATCCTGATCACCCCCGAGGGGGACGACAAGCCGGGCGCCGTGGGCAAGGT
GGTCCCGTTCTTCGAGGCCAAGGTGGTGGACCTGGACACCGGCAAGACCCTGGGCGTGAA
CCAGCGGGGCGAGCTGTGCGTGCGGGGGCCGATGATCATGAGCGGCTACGTGAACAACCC
GGAGGCCACCAACGCCCTCATCGACAAGGACGGCTGGCTGCACAGCGGCGACATCGCCTA
CTGGACGAGGACGAGCACTTCTTCATCGTCGACCGGCTGAAGTCGCTGATCAAGTACAA
GGGCTACCAGGTGGCGCCGGCCGAGCTGGAGAGCATCCTGCTCCAGCACCCCAACATCTT
CGACGCCGGCGTGGCCGGGCTGCCGGACGACGACGCCGGCGAGCTGCCGGCCGCGGTGGT
GGTGCTGGAGCACGGCAAGACCATGACGGAGAAGGAGATCGTCGACTACGTGGCCAGCCA
GGTGACCACCGCCAAGAAGCTGCGGGGCGGCGTGGTGTTCGTGGACGAGGTCCCGAAGGG
CCTGACCGGGAAGCTCGACGCCCGGAAGATCCGCGAGATCCTGATCAAGGCCAAGAAGGG
CGGCAAGATCGCCGTGTAAGACTAGTAGATCTAAAAAAAAAAAAAAAAAAAAAAAAAAAA
AAAAAAAAAAAAAAAAAAAAAAAAAAAAAAAAAAATGCATCCCCCCCCCCCCCCCCCC
CCCCCCCCCCCAAAGGCTCTTTTCAGAGCCACCAGAATT
```

RPL21-PpLuc(GC)-A64-C30-histoneSL
(SEQ ID NO: 1446)

```
GGGGCCGGAACCGCCATCTTCCAGTAATTCGCCAAAAAGCTTGAGGATGGAGGACGCCAA
GAACATCAAGAAGGGCCCGGCGCCCTTCTACCCGCTGGAGGACGGGACCGCCGGCGAGCA
GCTCCACAAGGCCATGAAGCGGTACGCCCTGGTGCCGGGCACGATCGCCTTCACCGACGC
CCACATCGAGGTCGACATCACCTACGCGGAGTACTTCGAGATGAGCGTGCGCCTGGCCGA
GGCCATGAAGCGGTACGGCCTGAACACCAACCACCGGATCGTGGTGTGCTCGGAGAACAG
CCTGCAGTTCTTCATGCCGGTGCTGGGCGCCCTCTTCATCGGCGTGGCCGTCGCCCCGGC
GAACGACATCTACAACGAGCGGGAGCTGCTGAACAGCATGGGGATCAGCCAGCCGACCGT
GGTGTTCGTGAGCAAGAAGGGCCTGCAGAAGATCCTGAACGTGCAGAAGAAGCTGCCCAT
CATCCAGAAGATCATCATCATGGACAGCAAGACCGACTACCAGGGCTTCCAGTCGATGTA
CACGTTCGTGACCAGCCACCTCCCGCCGGGCTTCAACGAGTACGACTTCGTCCCGGAGAG
CTTCGACCGGGACAAGACCATCGCCCTGATCATGAACAGCAGCGGCAGCACCGGCCTGCC
GAAGGGGGTGGCCCTGCCGCACCGGACCGCCTGCGTGCGCTTCTCGCACGCCCGGGACCC
CATCTTCGGCAACCAGATCATCCCGGACACCGCCATCCTGAGCGTGGTGCCGTTCCACCA
CGGCTTCGGCATGTTCACGACCCTGGGCTACCTCATCTGCGGCTTCCGGGTGGTCCTGAT
GTACCGGTTCGAGGAGGAGCTGTTCCTGCGGAGCCTGCAGGACTACAAGATCCAGAGCGC
GCTGCTCGTGCCGACCCTGTTCAGCTTCTTCGCCAAGAGCACCCTGATCGACAAGTACGA
CCTGTCGAACCTGCACGAGATCGCCAGCGGGGCGCCCCGCTGAGCAAGGAGGTGGGCGA
GGCCGTGGCCAAGCGGTTCCACCTCCCGGGCATCCGCCAGGGCTACGGCCTGACCGAGAC
CACGAGCGCGATCCTGATCACCCCCGAGGGGGACGACAAGCCGGGCGCCGTGGGCAAGGT
GGTCCCGTTCTTCGAGGCCAAGGTGGTGGACCTGGACACCGGCAAGACCCTGGGCGTGAA
CCAGCGGGGCGAGCTGTGCGTGCGGGGGCCGATGATCATGAGCGGCTACGTGAACAACCC
GGAGGCCACCAACGCCCTCATCGACAAGGACGGCTGGCTGCACAGCGGCGACATCGCCTA
CTGGGACGAGGACGAGCACTTCTTCATCGTCGACCGGCTGAAGTCGCTGATCAAGTACAA
GGGCTACCAGGTGGCGCCGGCCGAGCTGGAGAGCATCCTGCTCCAGCACCCCAACATCTT
CGACGCCGGCGTGGCCGGGCTGCCGGACGACGACGCCGGCGAGCTGCCGGCCGCGGTGGT
GGTGCTGGAGCACGGCAAGACCATGACGGAGAAGGAGATCGTCGACTACGTGGCCAGCCA
GGTGACCACCGCCAAGAAGCTGCGGGGCGGCGTGGTGTTCGTGGACGAGGTCCCGAAGGG
CCTGACCGGGAAGCTCGACGCCCGGAAGATCCGCGAGATCCTGATCAAGGCCAAGAAGGG
CGGCAAGATCGCCGTGTAAGACTAGTAGATCTAAAAAAAAAAAAAAAAAAAAAAAAAAAA
AAAAAAAAAAAAAAAAAAAAAAAAAAAAAAAAAAATGCATCCCCCCCCCCCCCCCCCC
CCCCCCCCCCCAAAGGCTCTTTTCAGAGCCACCAGAATT
```

ATP5A1-PpLuc(GC)-A64-C30-histoneSL
(SEQ ID NO: 1447)

```
GGGCGGCTCGGCCATTTTGTCCCAGTCAGTCCGGAGGCTGCGGCTGCAGAAGTACCGCCT
GCGGAGTAACTGCAAAGAAGCTTGAGGATGGAGGACGCCAAGAACATCAAGAAGGGCCCG
GCGCCCTTCTACCCGCTGGAGGACGGGACCGCCGGCGAGCAGCTCCACAAGGCCATGAAG
CGGTACGCCCTGGTGCCGGGCACGATCGCCTTCACCGACGCCCACATCGAGGTCGACATC
ACCTACGCGGAGTACTTCGAGATGAGCGTGCGCCTGGCCGAGGCCATGAAGCGGTACGGC
CTGAACACCAACCACCGGATCGTGGTGTGCTCGGAGAACAGCCTGCAGTTCTTCATGCCG
GTGCTGGGCGCCCTCTTCATCGGCGTGGCCGTCGCCCCGGCGAACGACATCTACAACGAG
CGGGAGCTGCTGAACAGCATGGGGATCAGCCAGCCGACCGTGGTGTTCGTGAGCAAGAAG
GGCCTGCAGAAGATCCTGAACGTGCAGAAGAAGCTGCCCATCATCCAGAAGATCATCATC
ATGGACAGCAAGACCGACTACCAGGGCTTCCAGTCGATGTACACGTTCGTGACCAGCCAC
CTCCCGCCGGGCTTCAACGAGTACGACTTCGTCCCGGAGAGCTTCGACCGGGACAAGACC
ATCGCCCTGATCATGAACAGCAGCGGCAGCACCGGCCTGCCGAAGGGGGTGGCCCTGCCG
CACCGGACCGCCTGCGTGCGCTTCTCGCACGCCCGGGACCCCATCTTCGGCAACCAGATC
ATCCCGGACACCGCCATCCTGAGCGTGGTGCCGTTCCACCACGGCTTCGGCATGTTCACG
ACCCTGGGCTACCTCATCTGCGGCTTCCGGGTGGTCCTGATGTACCGGTTCGAGGAGGAG
CTGTTCCTGCGGAGCCTGCAGGACTACAAGATCCAGAGCGCGCTGCTCGTGCCGACCCTG
TTCAGCTTCTTCGCCAAGAGCACCCTGATCGACAAGTACGATCTGTCGAACCTGCACGAG
ATCGCCAGCGGGGCGCCCCGCTGAGCAAGGAGGTGGGCGAGGCCGTGGCCAAGCGGTTC
CACCTCCCGGGCATCCGCCAGGGCTACGGCCTGACCGAGACCACGAGCGCGATCCTGATC
ACCCCCGAGGGGGACGACAAGCCGGGCGCCGTGGGCAAGGTGGTCCCGTTCTTCGAGGCC
AAGGTGGTGGACCTGGACACCGGCAAGACCCTGGGCGTGAACCAGCGGGGCGAGCTGTGC
GTGCGGGGGCCGATGATCATGAGCGGCTACGTGAACAACCCGGAGGCCACCAACGCCCTC
```

ATCGACAAGGACGGCTGGCTGCACAGCGGCGACATCGCCTACTGGGACGAGGACGAGCAC
TTCTTCATCGTCGACCGGCTGAAGTCGCTGATCAAGTACAAGGGCTACCAGGTGGCGCCG
GCCGAGCTGGAGAGCATCCTGCTCCAGCACCCCAACATCTTCGACGCCGGCGTGGCCGGG
CTGCCGGACGACGACGCCGGCGAGCTGCCGGCCGCGGTGGTGGTGCTGGAGCACGGCAAG
ACCATGACGGAGAAGGAGATCGTCGACTACGTGGCCAGCCAGGTGACCACCGCCAAGAAG
CTGCGGGGCGGCGTGGTGTTCGTGGACGAGGTCCCGAAGGGCCTGACCGGGAAGCTCGAC
GCCCGGAAGATCCGCGAGATCCTGATCAAGGCCAAGAAGGGCGGCAAGATCGCCGTGTAA
GACTAGTAGATCTAAAAAAAAAAAAAAAAAAAAAAAAAAAAAAAAAAAAAAAAAAAAAAA
AAAAAAAAAAAAAAATGCATCCCCCCCCCCCCCCCCCCCCCCCCCCCCAAAGGCT
CTTTTCAGAGCCACCAGAATT

HSD17B4-PpLuc(GC)-A64-C30-histoneSL (SEQ ID NO: 1448)

GGGTCCCGCAGTCGGCGTCCAGCGGCTCTGCTTGTTCGTGTGTGTGTCGTTGCAGGCCTT
ATTCAAGCTTGAGGATGGAGGACGCCAAGAACATCAAGAAGGGCCCGGCGCCCTTCTACC
CGCTGGAGGACGGGACCGCCGGCGAGCAGCTCCACAAGGCCATGAAGCGGTACGCCCTGG
TGCCGGGCACGATCGCCTTCACCGACGCCCACATCGAGGTCGACATCACCTACGCGGAGT
ACTTCGAGATGAGCGTGCGCCTGGCCGAGGCCATGAAGCGGTACGGCCTGAACACCAACC
ACCGGATCGTGGTGTGCTCGGAGAACAGCCTGCAGTTCTTCATGCCGGTGCTGGGCGCCC
TCTTCATCGGCGTGGCCGTCGCCCCGGCGAACGACATCTACAACGAGCGGGAGCTGCTGA
ACAGCATGGGGATCAGCCAGCCGACCGTGGTGTTCGTGAGCAAGAAGGGCCTGCAGAAGA
TCCTGAACGTGCAGAAGAAGCTGCCCATCATCCAGAAGATCATCATCATGGACAGCAAGA
CCGACTACCAGGGCTTCCAGTCGATGTACACGTTCGTGACCAGCCACCTCCCGCCGGGCT
TCAACGAGTACGACTTCGTCCCGGAGAGCTTCGACCGGGACAAGACCATCGCCCTGATCA
TGAACAGCAGCGGCAGCACCGGCCTGCCGAAGGGGGTGGCCCTGCCGCACCGGACCGCCT
GCGTGCGCTTCTCGCACGCCCGGGACCCCATCTTCGGCAACCAGATCATCCCGGACACCG
CCATCCTGAGCGTGGTGCCGTTCCACCACGGCTTCGGCATGTTCACGACCCTGGGCTACC
TCATCTGCGGCTTCCGGGTGGTCCTGATGTACCGGTTCGAGGAGGAGCTGTTCCTGCGGA
GCCTGCAGGACTACAAGATCCAGAGCGCGCTGCTCGTGCCGACCCTGTTCAGCTTCTTCG
CCAAGAGCACCCTGATCGACAAGTACGACCTGTCGAACCTGCACGAGATCGCCAGCGGGG
GCGCCCCGCTGAGCAAGGAGGTGGGCGAGGCCGTGGCCAAGCGGTTCCACCTCCCGGGCA
TCCGCCAGGGCTACGGCCTGACCGAGACCACGAGCGCGATCCTGATCACCCCCGAGGGGG
ACGACAAGCCGGGCGCCGTGGGCAAGGTGGTCCCGTTCTTCGAGGCCAAGGTGGTGGACC
TGGACACCGGCAAGACCCTGGGCGTGAACCAGCGGGGCGAGCTGTGCGTGCGGGGGCCGA
TGATCATGAGCGGCTACGTGAACAACCCGGAGGCCACCAACGCCCTCATCGACAAGGACG
GCTGGCTGCACAGCGGCGACATCGCCTACTGGGACGAGGACGAGCACTTCTTCATCGTCG
ACCGGCTGAAGTCGCTGATCAAGTACAAGGGCTACCAGGTGGCGCCGGCCGAGCTGGAGA
GCATCCTGCTCCAGCACCCCAACATCTTCGACGCCGGCGTGGCCGGGCTGCCGGACGACG
ACGCCGGCGAGCTGCCGGCCGCGGTGGTGGTGCTGGAGCACGGCAAGACCATGACGGAGA
AGGAGATCGTCGACTACGTGGCCAGCCAGGTGACCACCGCCAAGAAGCTGCGGGGCGGCG
TGGTGTTCGTGGACGAGGTCCCGAAGGGCCTGACCGGGAAGCTCGACGCCCGGAAGATCC
GCGAGATCCTGATCAAGGCCAAGAAGGGCGGCAAGATCGCCGTGTAAGACTAGTAGATCT
AAAAAAAAAAAAAAAAAAAAAAAAAAAAAAAAAAAAAAAAAAAAAAAAAAAAAAAAAAAA
AAAATGCATCCCCCCCCCCCCCCCCCCCCCCCCCCCCCCCAAAGGCTCTTTTCAGAGCCA
CCAGAATT

AIG1-PpLuc(GC)-A64-C30-histoneSL (SEQ ID NO: 1449)

GGGCCGCCCAGCCGGTCCAGGCCTCTGGCGAACAAGCTTGAGGATGGAGGACGCCAAGAA
CATCAAGAAGGGCCCGGCGCCCTTCTACCCGCTGGAGGACGGGACCGCCGGCGAGCAGCT
CCACAAGGCCATGAAGCGGTACGCCCTGGTGCCGGGCACGATCGCCTTCACCGACGCCCA
CATCGAGGTCGACATCACCTACGCGGAGTACTTCGAGATGAGCGTGCGCCTGGCCGAGGC
CATGAAGCGGTACGGCCTGAACACCAACCACCGGATCGTGGTGTGCTCGGAGAACAGCCT
GCAGTTCTTCATGCCGGTGCTGGGCGCCCTCTTCATCGGCGTGGCCGTCGCCCCGGCGAA
CGACATCTACAACGAGCGGGAGCTGCTGAACAGCATGGGGATCAGCCAGCCGACCGTGGT
GTTCGTGAGCAAGAAGGGCCTGCAGAAGATCCTGAACGTGCAGAAGAAGCTGCCCATCAT
CCAGAAGATCATCATCATGGACAGCAAGACCGACTACCAGGGCTTCCAGTCGATGTACAC
GTTCGTGACCAGCCACCTCCCGCCGGGCTTCAACGAGTACGACTTCGTCCCGGAGAGCTT
CGACCGGGACAAGACCATCGCCCTGATCATGAACAGCAGCGGCAGCACCGGCCTGCCGAA
GGGGGTGGCCCTGCCGCACCGGACCGCCTGCGTGCGCTTCTCGCACGCCCGGGACCCCAT
CTTCGGCAACCAGATCATCCCGGACACCGCCATCCTGAGCGTGGTGCCGTTCCACCACGG
CTTCGGCATGTTCACGACCCTGGGCTACCTCATCTGCGGCTTCCGGGTGGTCCTGATGTA
CCGGTTCGAGGAGGAGCTGTTCCTGCGGAGCCTGCAGGACTACAAGATCCAGAGCGCGCT
GCTCGTGCCGACCCTGTTCAGCTTCTTCGCCAAGAGCACCCTGATCGACAAGTACGACCT
GTCGAACCTGCACGAGATCGCCAGCGGGGGCGCCCCGCTGAGCAAGGAGGTGGGCGAGGC
CGTGGCCAAGCGGTTCCACCTCCCGGGCATCCGCCAGGGCTACGGCCTGACCGAGACCAC
GAGCGCGATCCTGATCACCCCCGAGGGGGACGACAAGCCGGGCGCCGTGGGCAAGGTGGT
CCCGTTCTTCGAGGCCAAGGTGGTGGACCTGGACACCGGCAAGACCCTGGGCGTGAACCA
GCGGGGCGAGCTGTGCGTGCGGGGGCCGATGATCATGAGCGGCTACGTGAACAACCCGGA
GGCCACCAACGCCCTCATCGACAAGGACGGCTGGCTGCACAGCGGCGACATCGCCTACTG
GGACGAGGACGAGCACTTCTTCATCGTCGACCGGCTGAAGTCGCTGATCAAGTACAAGGG
CTACCAGGTGGCGCCGGCCGAGCTGGAGAGCATCCTGCTCCAGCACCCCAACATCTTCGA
CGCCGGCGTGGCCGGGCTGCCGGACGACGACGCCGGCGAGCTGCCGGCCGCGGTGGTGGT
GCTGGAGCACGGCAAGACCATGACGGAGAAGGAGATCGTCGACTACGTGGCCAGCCAGGT
GACCACCGCCAAGAAGCTGCGGGGCGGCGTGGTGTTCGTGGACGAGGTCCCGAAGGGCCT
GACCGGGAAGCTCGACGCCCGGAAGATCCGCGAGATCCTGATCAAGGCCAAGAAGGGCGG
CAAGATCGCCGTGTAAGACTAGTAGATCTAAAAAAAAAAAAAAAAAAAAAAAAAAAAAAA
AAAAAAAAAAAAAAAAAAAAAAAAAAAAATGCATCCCCCCCCCCCCCCCCCCCCCCCCCC
CCCCCCCCAAAGGCTCTTTTCAGAGCCACCAGAATT

COX6C-PpLuc(GC)-A64-C30-histoneSL (SEQ ID NO: 1450)

GGAGTCAGGAAGGACGTTGGTGTTGAGGTTAGCATACGTATCAAGGACAGTAACTACCAA
GCTTGAGGATGGAGGACGCCAAGAACATCAAGAAGGGCCCGGCGCCCTTCTACCCGCTGG
AGGACGGGACCGCCGGCGAGCAGCTCCACAAGGCCATGAAGCGGTACGCCCTGGTGCCGG
GCACGATCGCCTTCACCGACGCCCACATCGAGGTCGACATCACCTACGCGGAGTACTTCG
AGATGAGCGTGCGCCTGGCCGAGGCCATGAAGCGGTACGGCCTGAACACCAACCACCGGA
TCGTGGTGTGCTCGGAGAACAGCCTGCAGTTCTTCATGCCGGTGCTGGGCGCCCTCTTCA
TCGGCGTGGCCGTCGCCCCGGCGAACGACATCTACAACGAGCGGGAGCTGCTGAACAGCA
TGGGGATCAGCCAGCCGACCGTGGTGTTCGTGAGCAAGAAGGGCCTGCAGAAGATCCTGA
ACGTGCAGAAGAAGCTGCCCATCATCCAGAAGATCATCATCATGGACAGCAAGACCGACT
ACCAGGGCTTCCAGTCGATGTACACGTTCGTGACCAGCCACCTCCCGCCGGGCTTCAACG
AGTACGACTTCGTCCCGGAGAGCTTCGACCGGGACAAGACCATCGCCCTGATCATGAACA
GCAGCGGCAGCACCGGCCTGCCGAAGGGGGTGGCCCTGCCGCACCGGACCGCCTGCGTGC
GCTTCTCGCACGCCCGGGACCCCATCTTCGGCAACCAGATCATCCCGGACACCGCCATCC
TGAGCGTGGTGCCGTTCCACCACGGCTTCGGCATGTTCACGACCCTGGGCTACCTCATCT
GCGGCTTCCGGGTGGTCCTGATGTACCGGTTCGAGGAGGAGCTGTTCCTGCGGAGCCTGC
AGGACTACAAGATCCAGAGCGCGCTGCTCGTGCCGACCCTGTTCAGCTTCTTCGCCAAGA
GCACCCTGATCGACAAGTACGACCTGTCGAACCTGCACGAGATCGCCAGCGGGGCGCCC
CGCTGAGCAAGGAGGTGGGCGAGGCCGTGGCCAAGCGGTTCCACCTCCCGGGCATCCGCC
AGGGCTACGGCCTGACCGAGACCACGAGCGCGATCCTGATCACCCCCGAGGGGGACGACA
AGCCGGGCGCCGTGGGCAAGGTGGTCCCGTTCTTCGAGGCCAAGGTGGTGGACCTGGACA
CCGGCAAGACCCTGGGCGTGAACCAGCGGGGCGAGCTGTGCGTGCGGGGGCCGATGATCA
TGAGCGGCTACGTGAACAACCCGGAGGCCACCAACGCCCTCATCGACAAGGACGGCTGGC
TGCACAGCGGCGACATCGCCTACTGGGACGAGGACGAGCACTTCTTCATCGTCGACCGGC
TGAAGTCGCTGATCAAGTACAAGGGCTACCAGGTGGCGCCGGCCGAGCTGGAGAGCATCC
TGCTCCAGCACCCCAACATCTTCGACGCCGGCGTGGCCGGGCTGCCGGACGACGACGCCG
GCGAGCTGCCGGCCGCGGTGGTGGTGCTGGAGCACGGCAAGACCATGACGGAGAAGGAGA
TCGTCGACTACGTGGCCAGCCAGGTGACCACCGCCAAGAAGCTGCGGGGCGGCGTGGTGT
TCGTGGACGAGGTCCCGAAGGGCCTGACCGGGAAGCTCGACGCCCGGAAGATCCGCGAGA
TCCTGATCAAGGCCAAGAAGGGCGGCAAGATCGCCGTGTAAGACTAGTAGATCTAAAAAA
AAAAAAAAAAAAAAAAAAAAAAAAAAAAAAAAAAAAAAAAAAAAAAAAAAAAAAAAAATG
CATCCCCCCCCCCCCCCCCCCCCCCCCCCCCAAAGGCTCTTTTCAGAGCCACCAGAA
TT

ASAH1-PpLuc(GC)-A64-C30-histoneSL (SEQ ID NO: 1451)

GGGCCTCTGCTGGAGTCCGGGGAGTGGCGTTGGCTGCTAGAGCGAAGCTTGAGGATGGAG
GACGCCAAGAACATCAAGAAGGGCCCGGCGCCCTTCTACCCGCTGGAGGACGGGACCGCC
GGCGAGCAGCTCCACAAGGCCATGAAGCGGTACGCCCTGGTGCCGGGCACGATCGCCTTC
ACCGACGCCCACATCGAGGTCGACATCACCTACGCGGAGTACTTCGAGATGAGCGTGCGC
CTGGCCGAGGCCATGAAGCGGTACGGCCTGAACACCAACCACCGGATCGTGGTGTGCTCG
GAGAACAGCCTGCAGTTCTTCATGCCGGTGCTGGGCGCCCTCTTCATCGGCGTGGCCGTC
GCCCCGGCGAACGACATCTACAACGAGCGGGAGCTGCTGAACAGCATGGGGATCAGCCAG
CCGACCGTGGTGTTCGTGAGCAAGAAGGGCCTGCAGAAGATCCTGAACGTGCAGAAGAAG
CTGCCCATCATCCAGAAGATCATCATCATGGACAGCAAGACCGACTACCAGGGCTTCCAG
TCGATGTACACGTTCGTGACCAGCCACCTCCCGCCGGGCTTCAACGAGTACGACTTCGTC
CCGGAGAGCTTCGACCGGGACAAGACCATCGCCCTGATCATGAACAGCAGCGGCAGCACC
GGCCTGCCGAAGGGGGTGGCCCTGCCGCACCGGACCGCCTGCGTGCGCTTCTCGCACGCC
CGGGACCCCATCTTCGGCAACCAGATCATCCCGGACACCGCCATCCTGAGCGTGGTGCCG
TTCCACCACGGCTTCGGCATGTTCACGACCCTGGGCTACCTCATCTGCGGCTTCCGGGTG
GTCCTGATGTACCGGTTCGAGGAGGAGCTGTTCCTGCGGAGCCTGCAGGACTACAAGATC
CAGAGCGCGCTGCTCGTGCCGACCCTGTTCAGCTTCTTCGCCAAGAGCACCCTGATCGAC
AAGTACGACCTGTCGAACCTGCACGAGATCGCCAGCGGGGCGCCCCGCTGAGCAAGGAG
GTGGGCGAGGCCGTGGCCAAGCGGTTCCACCTCCCGGGCATCCGCCAGGGCTACGGCCTG
ACCGAGACCACGAGCGCGATCCTGATCACCCCCGAGGGGGACGACAAGCCGGGCGCCGTG
GGCAAGGTGGTCCCGTTCTTCGAGGCCAAGGTGGTGGACCTGGACACCGGCAAGACCCTG
GGCGTGAACCAGCGGGGCGAGCTGTGCGTGCGGGGGCCGATGATCATGAGCGGCTACGTG
AACAACCCGGAGGCCACCAACGCCCTCATCGACAAGGACGGCTGGCTGCACAGCGGCGAC
ATCGCCTACTGGGACGAGGACGAGCACTTCTTCATCGTCGACCGGCTGAAGTCGCTGATC
AAGTACAAGGGCTACCAGGTGGCGCCGGCCGAGCTGGAGAGCATCCTGCTCCAGCACCCC
AACATCTTCGACGCCGGCGTGGCCGGGCTGCCGGACGACGACGCCGGCGAGCTGCCGGCC
GCGGTGGTGGTGCTGGAGCACGGCAAGACCATGACGGAGAAGGAGATCGTCGACTACGTG
GCCAGCCAGGTGACCACCGCCAAGAAGCTGCGGGGCGGCGTGGTGTTCGTGGACGAGGTC
CCGAAGGGCCTGACCGGGAAGCTCGACGCCCGGAAGATCCGCGAGATCCTGATCAAGGCC
AAGAAGGGCGGCAAGATCGCCGTGTAAGACTAGTAGATCTAAAAAAAAAAAAAAAAAAAA
AAAAAAAAAAAAAAAAAAAAAAAAAAAAAAAAAAAATGCATCCCCCCCCCCC
CCCCCCCCCCCCCCCCCCCAAAGGCTCTTTTCAGAGCCACCAGAATT

5'UTR of human ribosomal protein Large 35 (RPL35) lacking the 5'
terminal oligopyrimidine tract (SEQ ID NO: 1452)

GGAGCGGGCGGCGGCGTTGGCGGCTTGTGCAGCA

5'UTR of human ribosomal protein Large 21 (RPL21) lacking the 5'
terminal oligopyrimidine tract (SEQ ID NO: 1453)

GGCCGGAACCGCCATCTTCCAGTAATTCGCCAAA

5'UTR of human ATP synthase, H+ transporting, mitochondrial F1
complex, alpha subunit 1, cardiac muscle (ATP5A1) lacking the 5'
terminal oligopyrimidine tract (SEQ ID NO: 1454)

GCGGCTCGGCCATTTTGTCCCAGTCAGTCCGGAGGCTGCGGCTGCAGAAGTACCGCCTGCG
GAGTAACTGCAAAG

5'UTR of human hydroxysteroid (17-beta) dehydrogenase 4 (HSD17B4)
lacking the 5' terminal oligopyrimidine tract (SEQ ID NO: 1455)

GTCCCGCAGTCGGCGTCCAGCGGCTCTGCTTGTTCGTGTGTGTGTCGTTGCAGGCCTTATTC

5'UTR of human androgen-induced 1 (AIG1) lacking the 5' terminal
oligopyrimidine tract (SEQ ID NO: 1456)

GCCGCCCAGCCGGTCCAGGCCTCTGGCGAAC

5'UTR of human cytochrome c oxidase subunit VIc (COX6C) lacking
the 5' terminal oligopyrimidine tract (SEQ ID NO: 1457)

AGTCAGGAAGGACGTTGGTGTTGAGGTTAGCATACGTATCAAGGACAGTAACTACC

5'UTR of human N-acylsphingosine amidohydrolase (acid ceramidase)
(ASAH1) lacking the 5' terminal oligopyrimidine tract (SEQ ID NO: 1458)

GCCTCTGCTGGAGTCCGGGGAGTGGCGTTGGCTGCTAGAGCG

5'UTR of mouse ribosomal protein Large 21 (mRPL21) lacking the 5'
terminal oligopyrimidine tract (SEQ ID NO: 1459)

GGCCGCCGCAGCCATCTTCCAGTAACTCGCCAAA

5'UTR of mouse ribosomal protein large 35A (mRPL35A) lacking the
5' terminal oligopyrimidine tract (SEQ ID NO: 1460)

GCCATCTTGGCGCCTGTGGAGGCCTGCTGGGAACAGGACTTCTAACAGCAAGT

Mouse ribosomal protein Large 21 (mRPL21)

(SEQ ID NO: 1461)

TCCTCCTTTCGGCCGCCGCAGCCATCTTCCAGTAACTCGCCAAAATGCCATCTTCCAG
TAACTCGCCAAAATG mouse ribosomal protein large 35A (mRPL35A)

(SEQ ID NO: 1462)

CTTCCTCTTTCCGCCATCTTGGCGCCTGTGGAGGCCTGCTGGGAACAGGACTTCTAACAG
CAAGTATG

RPL32-PpLuc(GC)-ag-A64

(SEQ ID NO: 1463)

GGGGCGCTGCCTACGGAGGTGGCAGCCATCTCCTTCTCGGCATCAAGCTTGAGGATGGAG
GACGCCAAGAACATCAAGAAGGGCCCGGCGCCCTTCTACCCGCTGGAGGACGGGACCGCC
GGCGAGCAGCTCCACAAGGCCATGAAGCGGTACGCCCTGGTGCCGGGCACGATCGCCTTC
ACCGACGCCCACATCGAGGTCGACATCACCTACGCGGAGTACTTCGAGATGAGCGTGCGC
CTGGCCGAGGCCATGAAGCGGTACGGCCTGAACACCAACCACCGGATCGTGGTGTGCTCG
GAGAACAGCCTGCAGTTCTTCATGCCGGTGCTGGGCGCCCTCTTCATCGGCGTGGCCGTC
GCCCCGGCGAACGACATCTACAACGAGCGGGAGCTGCTGAACAGCATGGGGATCAGCCAG
CCGACCGTGGTGTTCGTGAGCAAGAAGGGCCTGCAGAAGATCCTGAACGTGCAGAAGAAG
CTGCCCATCATCCAGAAGATCATCATCATGGACAGCAAGACCGACTACCAGGGCTTCCAG
TCGATGTACACGTTCGTGACCAGCCACCTCCCGCCGGGCTTCAACGAGTACGACTTCGTC
CCGGAGAGCTTCGACCGGGACAAGACCATCGCCCTGATCATGAACAGCAGCGGCAGCACC
GGCCTGCCGAAGGGGGTGGCCCTGCCGCACCGGACCGCCTGCGTGCGCTTCTCGCACGCC
CGGGACCCCATCTTCGGCAACCAGATCATCCCGGACACCGCCATCCTGAGCGTGGTGCCG
TTCCACCACGGCTTCGGCATGTTCACGACCCTGGGCTACCTCATCTGCGGCTTCCGGGTG
GTCCTGATGTACCGGTTCGAGGAGGAGCTGTTCCTGCGGAGCCTGCAGGACTACAAGATC
CAGAGCGCGCTGCTCGTGCCGACCCTGTTCAGCTTCTTCGCCAAGAGCACCCTGATCGAC
AAGTACGACCTGTCGAACCTGCACGAGATCGCCAGCGGGGCGCCCCGCTGAGCAAGGAG
GTGGGCGAGGCCGTGGCCAAGCGGTTCCACCTCCCGGGCATCCGCCAGGGCTACGGCCTG
ACCGAGACCACGAGCGCGATCCTGATCACCCCCGAGGGGGACGACAAGCCGGGCGCCGTG
GGCAAGGTGGTCCCGTTCTTCGAGGCCAAGGTGGTGGACCTGGACACCGGCAAGACCCTG
GGCGTGAACCAGCGGGGCGAGCTGTGCGTGCGGGGGCCGATGATCATGAGCGGCTACGTG
AACAACCCGGAGGCCACCAACGCCCTCATCGACAAGGACGGCTGGCTGCACAGCGGCGAC
ATCGCCTACTGGGACGAGGACGAGCACTTCTTCATCGTCGACCGGCTGAAGTCGCTGATC
AAGTACAAGGGCTACCAGGTGGCGCCGGCCGAGCTGGAGAGCATCCTGCTCCAGCACCCC
AACATCTTCGACGCCGGCGTGGCCGGGCTGCCGGACGACGACGCCGGCGAGCTGCCGGCC
GCGGTGGTGGTGCTGGAGCACGGCAAGACCATGACGGAGAAGGAGATCGTCGACTACGTG
GCCAGCCAGGTGACCACCGCCAAGAAGCTGCGGGGCGGCGTGGTGTTCGTGGACGAGGTC
CCGAAGGGCCTGACCGGGAAGCTCGACGCCCGGAAGATCCGCGAGATCCTGATCAAGGCC
AAGAAGGGCGGCAAGATCGCCGTGTAAGACTAGTTATAAGACTGACTAGCCCGATGGGCC
TCCCAACGGGCCCTCCTCCCCTCCTTGCACCGAGATTAATAGATCTAAAAAAAAAAAAAA
AAAAAAAAAAAAAAAAAAAAAAAAAAAAAAAAAAAAAAAAAAAAAAAAA

-continued

PpLuc(GC)-ag-A64-histoneSL (SEQ ID NO: 1464)

GGGGCGCTGCCTACGGAGGTGGCAGCCATCTCCTTCTCGGCATCAAGCTTGAGGATGGAG
GACGCCAAGAACATCAAGAAGGGCCCGGCGCCCTTCTACCCGCTGGAGGACGGGACCGCC
GGCGAGCAGCTCCACAAGGCCATGAAGCGGTACGCCCTGGTGCCGGGCACGATCGCCTTC
ACCGACGCCCACATCGAGGTCGACATCACCTACGCGGAGTACTTCGAGATGAGCGTGCGC
CTGGCCGAGGCCATGAAGCGGTACGGCCTGAACACCAACCACCGGATCGTGGTGTGCTCG
GAGAACAGCCTGCAGTTCTTCATGCCGGTGCTGGGCGCCCTCTTCATCGGCGTGGCCGTC
GCCCCGGCGAACGACATCTACAACGAGCGGGAGCTGCTGAACAGCATGGGGATCAGCCAG
CCGACCGTGGTGTTCGTGAGCAAGAAGGGCCTGCAGAAGATCCTGAACGTGCAGAAGAAG
CTGCCCATCATCCAGAAGATCATCATCATGGACAGCAAGACCGACTACCAGGGCTTCCAG
TCGATGTACACGTTCGTGACCAGCCACCTCCCGCCGGGCTTCAACGAGTACGACTTCGTC
CCGGAGAGCTTCGACCGGGACAAGACCATCGCCCTGATCATGAACAGCAGCGGCAGCACC
GGCCTGCCGAAGGGGGTGGCCCTGCCGCACCGGACCGCCTGCGTGCGCTTCTCGCACGCC
CGGGACCCCATCTTCGGCAACCAGATCATCCCGGACACCGCCATCCTGAGCGTGGTGCCG
TTCCACCACGGCTTCGGCATGTTCACGACCCTGGGCTACCTCATCTGCGGCTTCCGGGTG
GTCCTGATGTACCGGTTCGAGGAGGAGCTGTTCCTGCGGAGCCTGCAGGACTACAAGATC
CAGAGCGCGCTGCTCGTGCCGACCCTGTTCAGCTTCTTCGCCAAGAGCACCCTGATCGAC
AAGTACGACCTGTCGAACCTGCACGAGATCGCCAGCGGGGGCGCCCCGCTGAGCAAGGAG
GTGGGCGAGGCCGTGGCCAAGCGGTTCCACCTCCCGGGCATCCGCCAGGGCTACGGCCTG
ACCGAGACCACGAGCGCGATCCTGATCACCCCCGAGGGGGACGACAAGCCGGGCGCCGTG
GGCAAGGTGGTCCCGTTCTTCGAGGCCAAGGTGGTGGACCTGGACACCGGCAAGACCCTG
GGCGTGAACCAGCGGGGCGAGCTGTGCGTGCGGGGGCCGATGATCATGAGCGGCTACGTG
AACAACCCGGAGGCCACCAACGCCCTCATCGACAAGGACGGCTGGCTGCACAGCGGCGAC
ATCGCCTACTGGGACGAGGACGAGCACTTCTTCATCGTCGACCGGCTGAAGTCGCTGATC
AAGTACAAGGGCTACCAGGTGGCGCCGGCCGAGCTGGAGAGCATCCTGCTCCAGCACCCC
AACATCTTCGACGCCGGCGTGGCCGGGCTGCCGGACGACGACGCCGGCGAGCTGCCGGCC
GCGGTGGTGGTGCTGGAGCACGGCAAGACCATGACGGAGAAGGAGATCGTCGACTACGTG
GCCAGCCAGGTGACCACCGCCAAGAAGCTGCGGGGCGGCGTGGTGTTCGTGGACGAGGTC
CCGAAGGGCCTGACCGGGAAGCTCGACGCCCGGAAGATCCGCGAGATCCTGATCAAGGCC
AAGAAGGGCGGCAAGATCGCCGTGTAAGACTAGTTATAAGACTGACTAGCCCGATGGGCC
TCCCAACGGGCCCTCCTCCCCTCCTTGCACCGAGATTAATAAAAAAAAAAAAAAAAAAAA
AAAAAAAAAAAAAAAAAAAAAAAAAAAAAAAAAAAAAAAAAAATGCATCAAAGGCTCTT
TTCAGAGCCACCA

PpLuc(GC)-albumin7-A64-C30-histoneSL (SEQ ID NO: 1465)

GGGGCGCTGCCTACGGAGGTGGCAGCCATCTCCTTCTCGGCATCAAGCTTGAGGATGGAG
GACGCCAAGAACATCAAGAAGGGCCCGGCGCCCTTCTACCCGCTGGAGGACGGGACCGCC
GGCGAGCAGCTCCACAAGGCCATGAAGCGGTACGCCCTGGTGCCGGGCACGATCGCCTTC
ACCGACGCCCACATCGAGGTCGACATCACCTACGCGGAGTACTTCGAGATGAGCGTGCGC
CTGGCCGAGGCCATGAAGCGGTACGGCCTGAACACCAACCACCGGATCGTGGTGTGCTCG
GAGAACAGCCTGCAGTTCTTCATGCCGGTGCTGGGCGCCCTCTTCATCGGCGTGGCCGTC
GCCCCGGCGAACGACATCTACAACGAGCGGGAGCTGCTGAACAGCATGGGGATCAGCCAG
CCGACCGTGGTGTTCGTGAGCAAGAAGGGCCTGCAGAAGATCCTGAACGTGCAGAAGAAG
CTGCCCATCATCCAGAAGATCATCATCATGGACAGCAAGACCGACTACCAGGGCTTCCAG
TCGATGTACACGTTCGTGACCAGCCACCTCCCGCCGGGCTTCAACGAGTACGACTTCGTC
CCGGAGAGCTTCGACCGGGACAAGACCATCGCCCTGATCATGAACAGCAGCGGCAGCACC
GGCCTGCCGAAGGGGGTGGCCCTGCCGCACCGGACCGCCTGCGTGCGCTTCTCGCACGCC
CGGGACCCCATCTTCGGCAACCAGATCATCCCGGACACCGCCATCCTGAGCGTGGTGCCG
TTCCACCACGGCTTCGGCATGTTCACGACCCTGGGCTACCTCATCTGCGGCTTCCGGGTG
GTCCTGATGTACCGGTTCGAGGAGGAGCTGTTCCTGCGGAGCCTGCAGGACTACAAGATC
CAGAGCGCGCTGCTCGTGCCGACCCTGTTCAGCTTCTTCGCCAAGAGCACCCTGATCGAC
AAGTACGACCTGTCGAACCTGCACGAGATCGCCAGCGGGGGCGCCCCGCTGAGCAAGGAG
GTGGGCGAGGCCGTGGCCAAGCGGTTCCACCTCCCGGGCATCCGCCAGGGCTACGGCCTG
ACCGAGACCACGAGCGCGATCCTGATCACCCCCGAGGGGGACGACAAGCCGGGCGCCGTG
GGCAAGGTGGTCCCGTTCTTCGAGGCCAAGGTGGTGGACCTGGACACCGGCAAGACCCTG
GGCGTGAACCAGCGGGGCGAGCTGTGCGTGCGGGGGCCGATGATCATGAGCGGCTACGTG
AACAACCCGGAGGCCACCAACGCCCTCATCGACAAGGACGGCTGGCTGCACAGCGGCGAC
ATCGCCTACTGGGACGAGGACGAGCACTTCTTCATCGTCGACCGGCTGAAGTCGCTGATC
AAGTACAAGGGCTACCAGGTGGCGCCGGCCGAGCTGGAGAGCATCCTGCTCCAGCACCCC
AACATCTTCGACGCCGGCGTGGCCGGGCTGCCGGACGACGACGCCGGCGAGCTGCCGGCC
GCGGTGGTGGTGCTGGAGCACGGCAAGACCATGACGGAGAAGGAGATCGTCGACTACGTG
GCCAGCCAGGTGACCACCGCCAAGAAGCTGCGGGGCGGCGTGGTGTTCGTGGACGAGGTC
CCGAAGGGCCTGACCGGGAAGCTCGACGCCCGGAAGATCCGCGAGATCCTGATCAAGGCC
AAGAAGGGCGGCAAGATCGCCGTGTAAGACTAGTGCATCACATTTAAAGCATCTCAGCC
TACCATGAGAATAAGAGAAAGAAAATGAAGATCAATAGCTTATTCATCTCTTTTTCTTTT
TCGTTGGTGTAAAGCCAACACCCTGTCTAAAAAACATAAATTTCTTTAATCATTTTGCCT
CTTTTCTCTGTGCTTCAATTAATAAAAAATGGAAAGAACCTAGATCTAAAAAAAAAAAA
AAAAAAAAAAAAAAAAAAAAAAAAAAAAAAAAAAAAAAAAAAAAAATGCATCCCC
CCCCCCCCCCCCCCCCCCCCCCCCAAAGGCTCTTTTCAGAGCCACCAGAATT

RPL35-PpLuc(GC)-ag-A64

(SEQ ID NO: 1466)

GGGGAGCGGGCGGCGGCGTTGGCGGCTTGTGCAGCAAAGCTTGAGGATGGAGGACGCCAA
GAACATCAAGAAGGGCCCGGCGCCCTTCTACCCGCTGGAGGACGGGACCGCCGGCGAGCA
GCTCCACAAGGCCATGAAGCGGTACGCCCTGGTGCCGGGCACGATCGCCTTCACCGACGC
CCACATCGAGGTCGACATCACCTACGCGGAGTACTTCGAGATGAGCGTGCGCCTGGCCGA
GGCCATGAAGCGGTACGGCCTGAACACCAACCACCGGATCGTGGTGTGCTCGGAGAACAG
CCTGCAGTTCTTCATGCCGGTGCTGGGCGCCCTCTTCATCGGCGTGGCCGTCGCCCCGGC

-continued

GAACGACATCTACAACGAGCGGGAGCTGCTGAACAGCATGGGGATCAGCCAGCCGACCGT
GGTGTTCGTGAGCAAGAAGGGCCTGCAGAAGATCCTGAACGTGCAGAAGAAGCTGCCCAT
CATCCAGAAGATCATCATCATGGACAGCAAGACCGACTACCAGGGCTTCCAGTCGATGTA
CACGTTCGTGACCAGCCACCTCCCGCCGGGCTTCAACGAGTACGACTTCGTCCCGGAGAG
CTTCGACCGGGACAAGACCATCGCCCTGATCATGAACAGCAGCGGCAGCACCGGCCTGCC
GAAGGGGGTGGCCCTGCCGCACCGGACCGCCTGCGTGCGCTTCTCGCACGCCCGGGACCC
CATCTTCGGCAACCAGATCATCCCGGACACCGCCATCCTGAGCGTGGTGCCGTTCCACCA
CGGCTTCGGCATGTTCACGACCCTGGGCTACCTCATCTGCGGCTTCCGGGTGGTCCTGAT
GTACCGGTTCGAGGAGGAGCTGTTCCTGCGGAGCCTGCAGGACTACAAGATCCAGAGCGC
GCTGCTCGTGCCGACCCTGTTCAGCTTCTTCGCCAAGAGCACCCTGATCGACAAGTACGA
CCTGTCGAACCTGCACGAGATCGCCAGCGGGGCGCCCCGCTGAGCAAGGAGGTGGGCGA
GGCCGTGGCCAAGCGGTTCCACCTCCCGGGCATCCGCCAGGGCTACGGCCTGACCGAGAC
CACGAGCGCGATCCTGATCACCCCCGAGGGGACGACAAGCCGGGCGCCGTGGGCAAGGT
GGTCCCGTTCTTCGAGGCCAAGGTGGTGGACCTGGACACCGGCAAGACCCTGGGCGTGAA
CCAGCGGGGCGAGCTGTGCGTGCGGGGGCCGATGATCATGAGCGGCTACGTGAACAACCC
GGAGGCCACCAACGCCCTCATCGACAAGGACGGCTGGCTGCACAGCGGCGACATCGCCTA
CTGGGACGAGGACGAGCACTTCTTCATCGTCGACCGGCTGAAGTCGCTGATCAAGTACAA
GGGCTACCAGGTGGCGCCGGCCGAGCTGGAGAGCATCCTGCTCCAGCACCCCAACATCTT
CGACGCCGGCGTGGCCGGGCTGCCGGACGACGACGCCGGCGAGCTGCCGGCCGCGGTGGT
GGTGCTGGAGCACGGCAAGACCATGACGGAGAAGGAGATCGTCGACTACGTGGCCAGCCA
GGTGACCACCGCCAAGAAGCTGCGGGGCGGCGTGGTGTTCGTGGACGAGGTCCCGAAGGG
CCTGACCGGGAAGCTCGACGCCCGGAAGATCCGCGAGATCCTGATCAAGGCCAAGAAGGG
CGGCAAGATCGCCGTGTAAGACTAGTTATAAGACTGACTAGCCCGATGGGCCTCCCAACG
GGCCCTCCTCCCCTCCTTGCACCGAGATTAATAAAAAAAAAAAAAAAAAAAAAAAAAAAA
AAAAAAAAAAAAAAAAAAAAAAAAAAAAAAAAA

RPL21-PpLuc(GC)-ag-A64                                          (SEQ ID NO: 1467)

GGGGCCGGAACCGCCATCTTCCAGTAATTCGCCAAAAAGCTTGAGGATGGAGGACGCCAA
GAACATCAAGAAGGGCCCGGCGCCCTTCTACCCGCTGGAGGACGGGACCGCCGGCGAGCA
GCTCCACAAGGCCATGAAGCGGTACGCCCTGGTGCCGGGCACGATCGCCTTCACCGACGC
CCACATCGAGGTCGACATCACCTACGCGGAGTACTTCGAGATGAGCGTGCGCCTGGCCGA
GGCCATGAAGCGGTACGGCCTGAACACCAACCACCGGATCGTGGTGTGCTCGGAGAACAG
CCTGCAGTTCTTCATGCCGGTGCTGGGCGCCCTCTTCATCGGCGTGGCCGTCGCCCCGGC
GAACGACATCTACAACGAGCGGGAGCTGCTGAACAGCATGGGGATCAGCCAGCCGACCGT
GGTGTTCGTGAGCAAGAAGGGCCTGCAGAAGATCCTGAACGTGCAGAAGAAGCTGCCCAT
CATCCAGAAGATCATCATCATGGACAGCAAGACCGACTACCAGGGCTTCCAGTCGATGTA
CACGTTCGTGACCAGCCACCTCCCGCCGGGCTTCAACGAGTACGACTTCGTCCCGGAGAG
CTTCGACCGGGACAAGACCATCGCCCTGATCATGAACAGCAGCGGCAGCACCGGCCTGCC
GAAGGGGGTGGCCCTGCCGCACCGGACCGCCTGCGTGCGCTTCTCGCACGCCCGGGACCC
CATCTTCGGCAACCAGATCATCCCGGACACCGCCATCCTGAGCGTGGTGCCGTTCCACCA
CGGCTTCGGCATGTTCACGACCCTGGGCTACCTCATCTGCGGCTTCCGGGTGGTCCTGAT
GTACCGGTTCGAGGAGGAGCTGTTCCTGCGGAGCCTGCAGGACTACAAGATCCAGAGCGC
GCTGCTCGTGCCGACCCTGTTCAGCTTCTTCGCCAAGAGCACCCTGATCGACAAGTACGA
CCTGTCGAACCTGCACGAGATCGCCAGCGGGGCGCCCCGCTGAGCAAGGAGGTGGGCGA
GGCCGTGGCCAAGCGGTTCCACCTCCCGGGCATCCGCCAGGGCTACGGCCTGACCGAGAC
CACGAGCGCGATCCTGATCACCCCCGAGGGGACGACAAGCCGGGCGCCGTGGGCAAGGT
GGTCCCGTTCTTCGAGGCCAAGGTGGTGGACCTGGACACCGGCAAGACCCTGGGCGTGAA
CCAGCGGGGCGAGCTGTGCGTGCGGGGGCCGATGATCATGAGCGGCTACGTGAACAACCC
GGAGGCCACCAACGCCCTCATCGACAAGGACGGCTGGCTGCACAGCGGCGACATCGCCTA
CTGGGACGAGGACGAGCACTTCTTCATCGTCGACCGGCTGAAGTCGCTGATCAAGTACAA
GGGCTACCAGGTGGCGCCGGCCGAGCTGGAGAGCATCCTGCTCCAGCACCCCAACATCTT
CGACGCCGGCGTGGCCGGGCTGCCGGACGACGACGCCGGCGAGCTGCCGGCCGCGGTGGT
GGTGCTGGAGCACGGCAAGACCATGACGGAGAAGGAGATCGTCGACTACGTGGCCAGCCA
GGTGACCACCGCCAAGAAGCTGCGGGGCGGCGTGGTGTTCGTGGACGAGGTCCCGAAGGG
CCTGACCGGGAAGCTCGACGCCCGGAAGATCCGCGAGATCCTGATCAAGGCCAAGAAGGG
CGGCAAGATCGCCGTGTAAGACTAGTTATAAGACTGACTAGCCCGATGGGCCTCCCAACG
GGCCCTCCTCCCCTCCTTGCACCGAGATTAATAAAAAAAAAAAAAAAAAAAAAAAAAAAA
AAAAAAAAAAAAAAAAAAAAAAAAAAAAAAAAA atp5a1-PpLuc(GC)-ag-A64                                          (SEQ ID NO: 1468)

GGGCGGCTCGGCCATTTTGTCCCAGTCAGTCCGGAGGCTGCGGCTGCAGAAGTACCGCCT
GCGGAGTAACTGCAAAGAAGCTTGAGGATGGAGGACGCCAAGAACATCAAGAAGGGCCCG
GCGCCCTTCTACCCGCTGGAGGACGGGACCGCCGGCGAGCAGCTCCACAAGGCCATGAAG
CGGTACGCCCTGGTGCCGGGCACGATCGCCTTCACCGACGCCCACATCGAGGTCGACATC
ACCTACGCGGAGTACTTCGAGATGAGCGTGCGCCTGGCCGAGGCCATGAAGCGGTACGGC
CTGAACACCAACCACCGGATCGTGGTGTGCTCGGAGAACAGCCTGCAGTTCTTCATGCCG
GTGCTGGGCGCCCTCTTCATCGGCGTGGCCGTCGCCCCGGCGAACGACATCTACAACGAG
CGGGAGCTGCTGAACAGCATGGGGATCAGCCAGCCGACCGTGGTGTTCGTGAGCAAGAAG
GGCCTGCAGAAGATCCTGAACGTGCAGAAGAAGCTGCCCATCATCCAGAAGATCATCATC
ATGGACAGCAAGACCGACTACCAGGGCTTCCAGTCGATGTACACGTTCGTGACCAGCCAC
CTCCCGCCGGGCTTCAACGAGTACGACTTCGTCCCGGAGAGCTTCGACCGGGACAAGACC
ATCGCCCTGATCATGAACAGCAGCGGCAGCACCGGCCTGCCGAAGGGGGTGGCCCTGCCG
CACCGGACCGCCTGCGTGCGCTTCTCGCACGCCCGGGACCCCATCTTCGGCAACCAGATC
ATCCCGGACACCGCCATCCTGAGCGTGGTGCCGTTCCACCACGGCTTCGGCATGTTCACG
ACCCTGGGCTACCTCATCTGCGGCTTCCGGGTGGTCCTGATGTACCGGTTCGAGGAGGAG
CTGTTCCTGCGGAGCCTGCAGGACTACAAGATCCAGAGCGCGCTGCTCGTGCCGACCCTG
TTCAGCTTCTTCGCCAAGAGCACCCTGATCGACAAGTACGACCTGTCGAACCTGCACGAG
ATCGCCAGCGGGGCGCCCCGCTGAGCAAGGAGGTGGGCGAGGCCGTGGCCAAGCGGTTC
CACCTCCCGGGCATCCGCCAGGGCTACGGCCTGACCGAGACCACGAGCGCGATCCTGATC

-continued

ACCCCCGAGGGGGACGACAAGCCGGGCGCCGTGGGCAAGGTGGTCCCGTTCTTCGAGGCC
AAGGTGGTGGACCTGGACACCGGCAAGACCCTGGGCGTGAACCAGCGGGGCGAGCTGTGC
GTGCGGGGGCCGATGATCATGAGCGGCTACGTGAACAACCCGGAGGCCACCAACGCCCTC
ATCGACAAGGACGGCTGGCTGCACAGCGGCGACATCGCCTACTGGGACGAGGACGAGCAC
TTCTTCATCGTCGACCGGCTGAAGTCGCTGATCAAGTACAAGGGCTACCAGGTGGCGCCG
GCCGAGCTGGAGAGCATCCTGCTCCAGCACCCCAACATCTTCGACGCCGGCGTGGCCGGG
CTGCCGGACGACGACGCCGGCGAGCTGCCGGCCGCGGTGGTGGTGCTGGAGCACGGCAAG
ACCATGACGGAGAAGGAGATCGTCGACTACGTGGCCAGCCAGGTGACCACCGCCAAGAAG
CTGCGGGGCGGCGTGGTGTTCGTGGACGAGGTCCCGAAGGGCCTGACCGGGAAGCTGCAC
GCCCGGAAGATCCGCGAGATCCTGATCAAGGCCAAGAAGGGCGGCAAGATCGCCGTGTAA
GACTAGTTATAAGACTGACTAGCCCGATGGGCCTCCCAACGGGCCCTCCTCCCCTCCTTG
CACCGAGATTAATAAAAAAAAAAAAAAAAAAAAAAAAAAAAAAAAAAAAAAAAAAAAAAA
AAAAAAAAAAAAAAAAA

HSD17B4-PpLuc(GC)-ag-A64                                       (SEQ ID NO: 1469)

GGGTCCCGCAGTCGGCGTCCAGCGGCTCTGCTTGTTCGTGTGTGTGTCGTTGCAGGCCTT
ATTCAAGCTTGAGGATGGAGGACGCCAAGAACATCAAGAAGGGGCCCGGCGCCCTTCTACC
CGCTGGAGGACGGGACCGCCGGCGAGCAGCTCCACAAGGCCATGAAGCGGTACGCCCTGG
TGCCGGGCACGATCGCCTTCACCGACGCCCACATCGAGGTCGACATCACCTACGCGGAGT
ACTTCGAGATGAGCGTGCGCCTGGCCGAGGCCATGAAGCGGTACGGCCTGAACACCAACC
ACCGGATCGTGGTGTGCTCGGAGAACAGCCTGCAGTTCTTCATGCCGGTGCTGGGCGCCC
TCTTCATCGGCGTGGCCGTCGCCCCGGCGAACGACATCTACAACGAGCGGGAGCTGCTGA
ACAGCATGGGGATCAGCCAGCCGACCGTGGTGTTCGTGAGCAAGAAGGGCCTGCAGAAGA
TCCTGAACGTGCAGAAGAAGCTGCCCATCATCCAGAAGATCATCATCATGGACAGCAAGA
CCGACTACCAGGGCTTCCAGTCGATGTACACGTTCGTGACCAGCCACCTCCCGCCGGGCT
TCAACGAGTACGACTTCGTCCCGGAGAGCTTCGACCGGGACAAGACCATCGCCCTGATCA
TGAACAGCAGCGGCAGCACCGGCCTGCCGAAGGGGGTGGCCCTGCCGCACCGGACCGCCT
GCGTGCGCTTCTCGCACGCCCGGGACCCCATCTTCGGCAACCAGATCATCCCGGACACCG
CCATCCTGAGCGTGGTGCCGTTCCACCACGGCTTCGGCATGTTCACGACCCTGGGCTACC
TCATCTGCGGCTTCCGGGTGGTCCTGATGTACCGGTTCGAGGAGGAGCTGTTCCTGCGGA
GCCTGCAGGACTACAAGATCCAGAGCGCGCTGCTCGTGCCGACCCTGTTCAGCTTCTTCG
CCAAGAGCACCCTGATCGACAAGTACGACCTGTCGAACCTGCACGAGATCGCCAGCGGGG
GCGCCCCGCTGAGCAAGGAGGTGGGCGAGGCCGTGGCCAAGCGGTTCCACCTCCCGGGCA
TCCGCCAGGGCTACGGCCTGACCGAGACCACGAGCGCGATCCTGATCACCCCCGAGGGGG
ACGACAAGCCGGGCGCCGTGGGCAAGGTGGTCCCGTTCTTCGAGGCCAAGGTGGTGGACC
TGGACACCGGCAAGACCCTGGGCGTGAACCAGCGGGGCGAGCTGTGCGTGCGGGGGCCGA
TGATCATGAGCGGCTACGTGAACAACCCGGAGGCCACCAACGCCCTCATCGACAAGGACG
GCTGGCTGCACAGCGGCGACATCGCCTACTGGGACGAGGACGAGCACTTCTTCATCGTCG
ACCGGCTGAAGTCGCTGATCAAGTACAAGGGCTACCAGGTGGCGCCGGCCGAGCTGGAGA
GCATCCTGCTCCAGCACCCCAACATCTTCGACGCCGGCGTGGCCGGGCTGCCGGACGACG
ACGCCGGCGAGCTGCCGGCCGCGGTGGTGGTGCTGGAGCACGGCAAGACCATGACGGAGA
AGGAGATCGTCGACTACGTGGCCAGCCAGGTGACCACCGCCAAGAAGCTGCGGGGCGGCG
TGGTGTTCGTGGACGAGGTCCCGAAGGGCCTGACCGGGAAGCTCGACGCCCGGAAGATCC
GCGAGATCCTGATCAAGGCCAAGAAGGGCGGCAAGATCGCCGTGTAAGACTAGTTATAAG
ACTGACTAGCCCGATGGGCCTCCCAACGGGCCCTCCTCCCCTCCTTGCACCGAGATTAAT
AAAAAAAAAAAAAAAAAAAAAAAAAAAAAAAAAAAAAAAAAAAAAAAAAAAAAAAAAAAA
AAAA

AIG1-PpLuc(GC)-ag-A64                                          (SEQ ID NO: 1470)

GGGCCGCCCAGCCGGTCCAGGCCTCTGGCGAACAAGCTTGAGGATGGAGGACGCCAAGAA
CATCAAGAAGGGCCCGGCGCCCTTCTACCCGCTGGAGGACGGGACCGCCGGCGAGCAGCT
CCACAAGGCCATGAAGCGGTACGCCCTGGTGCCGGGCACGATCGCCTTCACCGACGCCCA
CATCGAGGTCGACATCACCTACGCGGAGTACTTCGAGATGAGCGTGCGCCTGGCCGAGGC
CATGAAGCGGTACGGCCTGAACACCAACCACCGGATCGTGGTGTGCTCGGAGAACAGCCT
GCAGTTCTTCATGCCGGTGCTGGGCGCCCTCTTCATCGGCGTGGCCGTCGCCCCGGCGAA
CGACATCTACAACGAGCGGGAGCTGCTGAACAGCATGGGGATCAGCCAGCCGACCGTGGT
GTTCGTGAGCAAGAAGGGCCTGCAGAAGATCCTGAACGTGCAGAAGAAGCTGCCCATCAT
CCAGAAGATCATCATCATGGACAGCAAGACCGACTACCAGGGCTTCCAGTCGATGTACAC
GTTCGTGACCAGCCACCTCCCGCCGGGCTTCAACGAGTACGACTTCGTCCCGGAGAGCTT
CGACCGGGACAAGACCATCGCCCTGATCATGAACAGCAGCGGCAGCACCGGCCTGCCGAA
GGGGGTGGCCCTGCCGCACCGGACCGCCTGCGTGCGCTTCTCGCACGCCCGGGACCCCAT
CTTCGGCAACCAGATCATCCCGGACACCGCCATCCTGAGCGTGGTGCCGTTCCACCACGG
CTTCGGCATGTTCACGACCCTGGGCTACCTCATCTGCGGCTTCCGGGTGGTCCTGATGTA
CCGGTTCGAGGAGGAGCTGTTCCTGCGGAGCCTGCAGGACTACAAGATCCAGAGCGCGCT
GCTCGTGCCGACCCTGTTCAGCTTCTTCGCCAAGAGCACCCTGATCGACAAGTACGACCT
GTCGAACCTGCACGAGATCGCCAGCGGGGGCGCCCCGCTGAGCAAGGAGGTGGGCGAGGC
CGTGGCCAAGCGGTTCCACCTCCCGGGCATCCGCCAGGGCTACGGCCTGACCGAGACCAC
GAGCGCGATCCTGATCACCCCCGAGGGGACGACAAGCCGGGCGCCGTGGGCAAGGTGGT
CCCGTTCTTCGAGGCCAAGGTGGTGGACCTGGACACCGGCAAGACCCTGGGCGTGAACCA
GCGGGGCGAGCTGTGCGTGCGGGGGCCGATGATCATGAGCGGCTACGTGAACAACCCGGA
GGCCACCAACGCCCTCATCGACAAGGACGGCTGGCTGCACAGCGGCGACATCGCCTACTG
GGACGAGGACGAGCACTTCTTCATCGTCGACCGGCTGAAGTCGCTGATCAAGTACAAGGG
CTACCAGGTGGCGCCGGCCGAGCTGGAGAGCATCCTGCTCCAGCACCCCAACATCTTCGA
CGCCGGCGTGGCCGGGCTGCCGGACGACGACGCCGGCGAGCTGCCGGCCGCGGTGGTGGT
GCTGGAGCACGGCAAGACCATGACGGAGAAGGAGATCGTCGACTACGTGGCCAGCCAGGT
GACCACCGCCAAGAAGCTGCGGGGCGGCGTGGTGTTCGTGGACGAGGTCCCGAAGGGCCT
GACCGGGAAGCTCGACGCCCGGAAGATCCGCGAGATCCTGATCAAGGCCAAGAAGGGCGG
CAAGATCGCCGTGTAAGACTAGTTATAAGACTGACTAGCCCGATGGGCCTCCCAACGGGC

-continued

CCTCCTCCCCTCCTTGCACCGAGATTAATAAAAAAAAAAAAAAAAAAAAAAAAAAAAAAAA
AAAAAAAAAAAAAAAAAAAAAAAAAAAAAAAA

COX6C-PpLuc(GC)-ag-A64 (SEQ ID NO: 1471)

GGAGTCAGGAAGGACGTTGGTGTTGAGGTTAGCATACGTATCAAGGACAGTAACTACCAA
GCTTGAGGATGGAGGACGCCAAGAACATCAAGAAGGGCCCGGCGCCCTTCTACCCGCTGG
AGGACGGGACCGCCGGCGAGCAGCTCCACAAGGCCATGAAGCGGTACGCCCTGGTGCCGG
GCACGATCGCCTTCACCGACGCCCACATCGAGGTCGACATCACCTACGCGGAGTACTTCG
AGATGAGCGTGCGCCTGGCCGAGGCCATGAAGCGGTACGGCCTGAACACCAACCACCGGA
TCGTGGTGTGCTCGGAGAACAGCCTGCAGTTCTTCATGCCGGTGCTGGGCGCCCTCTTCA
TCGGCGTGGCCGTCGCCCCGGCGAACGACATCTACAACGAGCGGGAGCTGCTGAACAGCA
TGGGGATCAGCCAGCCGACCGTGGTGTTCGTGAGCAAGAAGGGCCTGCAGAAGATCCTGA
ACGTGCAGAAGAAGCTGCCCATCATCCAGAAGATCATCATCATGGACAGCAAGACCGACT
ACCAGGGCTTCCAGTCGATGTACACGTTCGTGACCAGCCACCTCCCGCCGGGCTTCAACG
AGTACGACTTCGTCCCGGAGAGCTTCGACCGGGACAAGACCATCGCCCTGATCATGAACA
GCAGCGGCAGCACCGGCCTGCCGAAGGGGGTGGCCCTGCCGCACCGGACCGCCTGCGTGC
GCTTCTCGCACGCCCGGGACCCCATCTTCGGCAACCAGATCATCCCGGACACCGCCATCC
TGAGCGTGGTGCCGTTCCACCACGGCTTCGGCATGTTCACGACCCTGGGCTACCTCATCT
GCGGCTTCCGGGTGGTCCTGATGTACCGGTTCGAGGAGGAGCTGTTCCTGCGGAGCCTGC
AGGACTACAAGATCCAGAGCGCGCTGCTCGTGCCGACCCTGTTCAGCTTCTTCGCCAAGA
GCACCCTGATCGACAAGTACGACCTGTCGAACCTGCACGAGATCGCCAGCGGGGGCGCCC
CGCTGAGCAAGGAGGTGGGCGAGGCCGTGGCCAAGCGGTTCCACCTCCCGGGCATCCGCC
AGGGCTACGGCCTGACCGAGACCACGAGCGCGATCCTGATCACCCCCGAGGGGGACGACA
AGCCGGGCGCCGTGGGCAAGGTGGTCCCGTTCTTCGAGGCCAAGGTGGTGGACCTGGACA
CCGGCAAGACCCTGGGCGTGAACCAGCGGGGCGAGCTGTGCGTGCGGGGGCCGATGATCA
TGAGCGGCTACGTGAACAACCCGGAGGCCACCAACGCCCTCATCGACAAGGACGGCTGGC
TGCACAGCGGCGACATCGCCTACTGGGACGAGGACGAGCACTTCTTCATCGTCGACCGGC
TGAAGTCGCTGATCAAGTACAAGGGCTACCAGGTGGCGCCCGGCCGAGCTGGAGAGCATCC
TGCTCCAGCACCCCAACATCTTCGACGCCGGCGTGGCCGGCTGCCGGACGACGACGCCG
GCGAGCTGCCGGCCGCGGTGGTGGTGCTGGAGCACGGCAAGACCATGACGGAGAAGGAGA
TCGTCGACTACGTGGCCAGCCAGGTGACCACCGCCAAGAAGCTGCGGGGCGGCGTGGTGT
TCGTGGACGAGGTCCCGAAGGGCCTGACCGGGAAGCTCGACGCCCGGAAGATCCGCGAGA
TCCTGATCAAGGCCAAGAAGGGCGGCAAGATCGCCGTGTAAGACTAGTTATAAGACTGAC
TAGCCCGATGGGCCTCCCAACGGGCCCTCCTCCCCTCCTTGCACCGAGATTAATAAAAAA
AAAAAAAAAAAAAAAAAAAAAAAAAAAAAAAAAAAAAAAAAAAAAAAAAA

ASAH1-PpLuc(GC)-ag-A64 (SEQ ID NO: 1472)

GGGCCTCTGCTGGAGTCCGGGGAGTGGCGTTGGCTGCTAGAGCGAAGCTTGAGGATGGAG
GACGCCAAGAACATCAAGAAGGGCCCGGCGCCCTTCTACCCGCTGGAGGACGGGACCGCC
GGCGAGCAGCTCCACAAGGCCATGAAGCGGTACGCCCTGGTGCCGGGCACGATCGCCTTC
ACCGACGCCCACATCGAGGTCGACATCACCTACGCGGAGTACTTCGAGATGAGCGTGCGC
CTGGCCGAGGCCATGAAGCGGTACGGCCTGAACACCAACCACCGGATCGTGGTGTGCTCG
GAGAACAGCCTGCAGTTCTTCATGCCGGTGCTGGGCGCCCTCTTCATCGGCGTGGCCGTC
GCCCCGGCGAACGACATCTACAACGAGCGGGAGCTGCTGAACAGCATGGGGATCAGCCAG
CCGACCGTGGTGTTCGTGAGCAAGAAGGGCCTGCAGAAGATCCTGAACGTGCAGAAGAAG
CTGCCCATCATCCAGAAGATCATCATCATGGACAGCAAGACCGACTACCAGGGCTTCCAG
TCGATGTACACGTTCGTGACCAGCCACCTCCCGCCGGGCTTCAACGAGTACGACTTCGTC
CCGGAGAGCTTCGACCGGGACAAGACCATCGCCCTGATCATGAACAGCAGCGGCAGCACC
GGCCTGCCGAAGGGGGTGGCCCTGCCGCACCGGACCGCCTGCGTGCGCTTCTCGCACGCC
CGGGACCCCATCTTCGGCAACCAGATCATCCCGGACACCGCCATCCTGAGCGTGGTGCCG
TTCCACCACGGCTTCGGCATGTTCACGACCCTGGGCTACCTCATCTGCGGCTTCCGGGTG
GTCCTGATGTACCGGTTCGAGGAGGAGCTGTTCCTGCGGAGCCTGCAGGACTACAAGATC
CAGAGCGCGCTGCTCGTGCCGACCCTGTTCAGCTTCTTCGCCAAGAGCACCCTGATCGAC
AAGTACGACCTGTCGAACCTGCACGAGATCGCCAGCGGGGGCGCCCCGCTGAGCAAGGAG
GTGGGCGAGGCCGTGGCCAAGCGGTTCCACCTCCCGGGCATCCGCCAGGGCTACGGCCTG
ACCGAGACCACGAGCGCGATCCTGATCACCCCCGAGGGGGACGACAAGCCGGGCGCCGTG
GGCAAGGTGGTCCCGTTCTTCGAGGCCAAGGTGGTGGACCTGGACACCGGCAAGACCCTG
GGCGTGAACCAGCGGGGCGAGCTGTGCGTGCGGGGGCCGATGATCATGAGCGGCTACGTG
AACAACCCGGAGGCCACCAACGCCCTCATCGACAAGGACGGCTGGCTGCACAGCGGCGAC
ATCGCCTACTGGGACGAGGACGAGCACTTCTTCATCGTCGACCGGCTGAAGTCGCTGATC
AAGTACAAGGGCTACCAGGTGGCGCCCGGCCGAGCTGGAGAGCATCCTGCTCCAGCACCCC
AACATCTTCGACGCCGGCGTGGCCGGCTGCCGGACGACGACGCCGAGCTGCCGGCCGCC
GCGGTGGTGGTGCTGGAGCACGGCAAGACCATGACGGAGAAGGAGATCGTCGACTACGTG
GCCAGCCAGGTGACCACCGCCAAGAAGCTGCGGGGCGGCGTGGTGTTCGTGGACGAGGTC
CCGAAGGGCCTGACCGGGAAGCTCGACGCCCGGAAGATCCGCGAGATCCTGATCAAGGCC
AAGAAGGGCGGCAAGATCGCCGTGTAAGACTAGTTATAAGACTGACTAGCCCGATGGGCC
TCCCAACGGGCCCTCCTCCCCTCCTTGCACCGAGATTAATAAAAAAAAAAAAAAAAAAAA
AAAAAAAAAAAAAAAAAAAAAAAAAAAAAAAAAAAAAA

RPL35-PpLuc(GC)-ag-A64-histoneSL (SEQ ID NO: 1473)

GGGGAGCGGGCGGCGGCGTTGGCGGCTTGTGCAGCAAAGCTTGAGGATGGAGGACGCCAA
GAACATCAAGAAGGGCCCGGCGCCCTTCTACCCGCTGGAGGACGGGACCGCCGGCGAGCA
GCTCCACAAGGCCATGAAGCGGTACGCCCTGGTGCCGGGCACGATCGCCTTCACCGACGC
CCACATCGAGGTCGACATCACCTACGCGGAGTACTTCGAGATGAGCGTGCGCCTGGCCGA
GGCCATGAAGCGGTACGGCCTGAACACCAACCACCGGATCGTGGTGTGCTCGGAGAACAG
CCTGCAGTTCTTCATGCCGGTGCTGGGCGCCCTCTTCATCGGCGTGGCCGTCGCCCCGGC
GAACGACATCTACAACGAGCGGGAGCTGCTGAACAGCATGGGGATCAGCCAGCCGACCGT
GGTGTTCGTGAGCAAGAAGGGCCTGCAGAAGATCCTGAACGTGCAGAAGAAGCTGCCCAT

-continued

CATCCAGAAGATCATCATCATGGACAGCAAGACCGACTACCAGGGCTTCCAGTCGATGTA
CACGTTCGTGACCAGCCACCTCCCGCCGGGCTTCAACGAGTACGACTTCGTCCCGGAGAG
CTTCGACCGGGACAAGACCATCGCCCTGATCATGAACAGCAGCGGCAGCACCGGCCTGCC
GAAGGGGGTGGCCCTGCCGCACCGGACCGCCTGCGTGCGCTTCTCGCACGCCCGGGACCC
CATCTTCGGCAACCAGATCATCCCGGACACCGCCATCCTGAGCGTGGTGCCGTTCCACCA
CGGCTTCGGCATGTTCACGACCCTGGGCTACCTCATCTGCGGCTTCCGGGTGGTCCTGAT
GTACCGGTTCGAGGAGGAGCTGTTCCTGCGGAGCCTGCAGGACTACAAGATCCAGAGCGC
GCTGCTCGTGCCGACCCTGTTCAGCTTCTTCGCCAAGAGCACCCTGATCGACAAGTACGA
CCTGTCGAACCTGCACGAGATCGCCAGCGGGGGCGCCCCGCTGAGCAAGGAGGTGGGCGA
GGCCGTGGCCAAGCGGTTCCACCTCCCGGGCATCCGCCAGGGCTACGGCCTGACCGAGAC
CACGAGCGCGATCCTGATCACCCCCGAGGGGGACGACAAGCCGGGCGCCGTGGGCAAGGT
GGTCCCGTTCTTCGAGGCCAAGGTGGTGGACCTGGACACCGGCAAGACCCTGGGCGTGAA
CCAGCGGGGCGAGCTGTGCGTGCGGGGGCCGATGATCATGAGCGGCTACGTGAACAACCC
GGAGGCCACCAACGCCCTCATCGACAAGGACGGCTGGCTGCACAGCGGCGACATCGCCTA
CTGGGACGAGGACGAGCACTTCTTCATCGTCGACCGGCTGAAGTCGCTGATCAAGTACAA
GGGCTACCAGGTGGCGCCGGCCGAGCTGGAGAGCATCCTGCTCCAGCACCCCAACATCTT
CGACGCCGGCGTGGCCGGGCTGCCGGACGACGACGCCGGCGAGCTGCCGGCCGCGGTGGT
GGTGCTGGAGCACGGCAAGACCATGACGGAGAAGGAGATCGTCGACTACGTGGCCAGCCA
GGTGACCACCGCCAAGAAGCTGCGGGGCGGCGTGGTGTTCGTGGACGAGGTCCCGAAGGG
CCTGACCGGGAAGCTCGACGCCCGGAAGATCCGCGAGATCCTGATCAAGGCCAAGAAGGG
CGGCAAGATCGCCGTGTAAGACTAGTTATAAGACTGACTAGCCCGATGGGCCTCCCAACG
GGCCCTCCTCCCCTCCTTGCACCGAGATTAATAAAAAAAAAAAAAAAAAAAAAAAAAAAA
AAAAAAAAAAAAAAAAAAAAAAAAAAAAAAAAAATGCATCAAAGGCTCTTTTCAGAGC
CACCA

RPL21-PpLuc(GC)-ag-A64-histoneSL                                (SEQ ID NO: 1474)

GGGGCCGGAACCGCCATCTTCCAGTAATTCGCCAAAAAGCTTGAGGATGGAGGACGCCAA
GAACATCAAGAAGGGCCCGGCGCCCTTCTACCCGCTGGAGGACGGGACCGCCGGCGAGCA
GCTCCACAAGGCCATGAAGCGGTACGCCCTGGTGCCGGGCACGATCGCCTTCACCGACGC
CCACATCGAGGTCGACATCACCTACGCGGAGTACTTCGAGATGAGCGTGCGCCTGGCCGA
GGCCATGAAGCGGTACGGCCTGAACACCAACCACCGGATCGTGGTGTGCTCGGAGAACAG
CCTGCAGTTCTTCATGCCGGTGCTGGGCGCCCTCTTCATCGGCGTGGCCGTCGCCCCGGC
GAACGACATCTACAACGAGCGGGAGCTGCTGAACAGCATGGGGATCAGCCAGCCGACCGT
GGTGTTCGTGAGCAAGAAGGGCCTGCAGAAGATCCTGAACGTGCAGAAGAAGCTGCCCAT
CATCCAGAAGATCATCATCATGGACAGCAAGACCGACTACCAGGGCTTCCAGTCGATGTA
CACGTTCGTGACCAGCCACCTCCCGCCGGGCTTCAACGAGTACGACTTCGTCCCGGAGAG
CTTCGACCGGGACAAGACCATCGCCCTGATCATGAACAGCAGCGGCAGCACCGGCCTGCC
GAAGGGGGTGGCCCTGCCGCACCGGACCGCCTGCGTGCGCTTCTCGCACGCCCGGGACCC
CATCTTCGGCAACCAGATCATCCCGGACACCGCCATCCTGAGCGTGGTGCCGTTCCACCA
CGGCTTCGGCATGTTCACGACCCTGGGCTACCTCATCTGCGGCTTCCGGGTGGTCCTGAT
GTACCGGTTCGAGGAGGAGCTGTTCCTGCGGAGCCTGCAGGACTACAAGATCCAGAGCGC
GCTGCTCGTGCCGACCCTGTTCAGCTTCTTCGCCAAGAGCACCCTGATCGACAAGTACGA
CCTGTCGAACCTGCACGAGATCGCCAGCGGGGGCGCCCCGCTGAGCAAGGAGGTGGGCGA
GGCCGTGGCCAAGCGGTTCCACCTCCCGGGCATCCGCCAGGGCTACGGCCTGACCGAGAC
CACGAGCGCGATCCTGATCACCCCCGAGGGGGACGACAAGCCGGGCGCCGTGGGCAAGGT
GGTCCCGTTCTTCGAGGCCAAGGTGGTGGACCTGGACACCGGCAAGACCCTGGGCGTGAA
CCAGCGGGGCGAGCTGTGCGTGCGGGGGCCGATGATCATGAGCGGCTACGTGAACAACCC
GGAGGCCACCAACGCCCTCATCGACAAGGACGGCTGGCTGCACAGCGGCGACATCGCCTA
CTGGGACGAGGACGAGCACTTCTTCATCGTCGACCGGCTGAAGTCGCTGATCAAGTACAA
GGGCTACCAGGTGGCGCCGGCCGAGCTGGAGAGCATCCTGCTCCAGCACCCCAACATCTT
CGACGCCGGCGTGGCCGGGCTGCCGGACGACGACGCCGGCGAGCTGCCGGCCGCGGTGGT
GGTGCTGGAGCACGGCAAGACCATGACGGAGAAGGAGATCGTCGACTACGTGGCCAGCCA
GGTGACCACCGCCAAGAAGCTGCGGGGCGGCGTGGTGTTCGTGGACGAGGTCCCGAAGGG
CCTGACCGGGAAGCTCGACGCCCGGAAGATCCGCGAGATCCTGATCAAGGCCAAGAAGGG
CGGCAAGATCGCCGTGTAAGACTAGTTATAAGACTGACTAGCCCGATGGGCCTCCCAACG
GGCCCTCCTCCCCTCCTTGCACCGAGATTAATAAAAAAAAAAAAAAAAAAAAAAAAAAAA
AAAAAAAAAAAAAAAAAAAAAAAAAAAAAAAAAATGCATCAAAGGCTCTTTTCAGAGC
CACCA atp5a1-PpLuc(GC)-ag-A64-histoneSL                               (SEQ ID NO: 1475)

GGGCGGCTCGGCCATTTTGTCCCAGTCAGTCCGGAGGCTGCGGCTGCAGAAGTACCGCCT
GCGGAGTAACTGCAAAGAAGCTTGAGGATGGAGGACGCCAAGAACATCAAGAAGGGCCCG
GCGCCCTTCTACCCGCTGGAGGACGGGACCGCCGGCGAGCAGCTCCACAAGGCCATGAAG
CGGTACGCCCTGGTGCCGGGCACGATCGCCTTCACCGACGCCCACATCGAGGTCGACATC
ACCTACGCGGAGTACTTCGAGATGAGCGTGCGCCTGGCCGAGGCCATGAAGCGGTACGGC
CTGAACACCAACCACCGGATCGTGGTGTGCTCGGAGAACAGCCTGCAGTTCTTCATGCCG
GTGCTGGGCGCCCTCTTCATCGGCGTGGCCGTCGCCCCGGCGAACGACATCTACAACGAG
CGGGAGCTGCTGAACAGCATGGGGATCAGCCAGCCGACCGTGGTGTTCGTGAGCAAGAAG
GGCCTGCAGAAGATCCTGAACGTGCAGAAGAAGCTGCCCATCATCCAGAAGATCATCATC
ATGGACAGCAAGACCGACTACCAGGGCTTCCAGTCGATGTACACGTTCGTGACCAGCCAC
CTCCCGCCGGGCTTCAACGAGTACGACTTCGTCCCGGAGAGCTTCGACCGGGACAAGACC
ATCGCCCTGATCATGAACAGCAGCGGCAGCACCGGCCTGCCGAAGGGGGTGGCCCTGCCG
CACCGGACCGCCTGCGTGCGCTTCTCGCACGCCCGGGACCCCATCTTCGGCAACCAGATC
ATCCCGGACACCGCCATCCTGAGCGTGGTGCCGTTCCACCACGGCTTCGGCATGTTCACG
ACCCTGGGCTACCTCATCTGCGGCTTCCGGGTGGTCCTGATGTACCGGTTCGAGGAGGAG
CTGTTCCTGCGGAGCCTGCAGGACTACAAGATCCAGAGCGCGCTGCTCGTGCCGACCCTG
TTCAGCTTCTTCGCCAAGAGCACCCTGATCGACAAGTACGACCTGTCGAACCTGCACGAG
ATCGCCAGCGGGGGCGCCCCGCTGAGCAAGGAGGTGGGCGAGGCCGTGGCCAAGCGGTTC
CACCTCCCGGGCATCCGCCAGGGCTACGGCCTGACCGAGACCACGAGCGCGATCCTGATC

-continued

ACCCCCGAGGGGGACGACAAGCCGGGCGCCGTGGGCAAGGTGGTCCCGTTCTTCGAGGCC
AAGGTGGTGGACCTGGACACCGGCAAGACCCTGGGCGTGAACCAGCGGGGCGAGCTGTGC
GTGCGGGGGCCGATGATCATGAGCGGCTACGTGAACAACCCGGAGGCCACCAACGCCCTC
ATCGACAAGGACGGCTGGCTGCACAGCGGCGACATCGCCTACTGGGACGAGGACGAGCAC
TTCTTCATCGTCGACCGGCTGAAGTCGCTGATCAAGTACAAGGGCTACCAGGTGGCGCCG
GCCGAGCTGGAGAGCATCCTGCTCCAGCACCCCAACATCTTCGACGCCGGCGTGGCCGGG
CTGCCGGACGACGACGCCGGCGAGCTGCCGGCCGCGGTGGTGGTGCTGGAGCACGGCAAG
ACCATGACGGAGAAGGAGATCGTCGACTACGTGGCCAGCCAGGTGACCACCGCCAAGAAG
CTGCGGGGCGGCGTGGTGTTCGTGGACGAGGTCCCGAAGGGCCTGACCGGGAAGCTCGAC
GCCCGGAAGATCCGCGAGATCCTGATCAAGGCCAAGAAGGGCGGCAAGATCGCCGTGTAA
GACTAGTTATAAGACTGACTAGCCCGATGGGCCTCCCAACGGGCCCTCCTCCCCTCCTTG
CACCGAGATTAATAAAAAAAAAAAAAAAAAAAAAAAAAAAAAAAAAAAAAAAAAAAAAAA
AAAAAAAAAAAAAAAAATGCATCAAAGGCTCTTTTCAGAGCCACCA

HSD17B4-PpLuc(GC)-ag-A64-histoneSL
(SEQ ID NO: 1476)

GGGTCCCGCAGTCGGCGTCCAGCGGCTCTGCTTGTTCGTGTGTGTGTCGTTGCAGGCCTT
ATTCAAGCTTGAGGATGGAGGACGCCAAGAACATCAAGAAGGGCCCGGCGCCCTTCTACC
CGCTGGAGGACGGGACCGCCGGCGAGCAGCTCCACAAGGCCATGAAGCGGTACGCCCTGG
TGCCGGGCACGATCGCCTTCACCGACGCCCACATCGAGGTCGACATCACCTACGCGGAGT
ACTTCGAGATGAGCGTGCGCCTGGCCGAGGCCATGAAGCGGTACGGCCTGAACACCAACC
ACCGGATCGTGGTGTGCTCGGAGAACAGCCTGCAGTTCTTCATGCCGGTGCTGGGCGCCC
TCTTCATCGGCGTGGCCGTCGCCCCGGCGAACGACATCTACAACGAGCGGGAGCTGCTGA
ACAGCATGGGGATCAGCCAGCCGACCGTGGTGTTCGTGAGCAAGAAGGGCCTGCAGAAGA
TCCTGAACGTGCAGAAGAAGCTGCCCATCATCCAGAAGATCATCATCATGGACAGCAAGA
CCGACTACCAGGGCTTCCAGTCGATGTACACGTTCGTGACCAGCCACCTCCCGCCGGGCT
TCAACGAGTACGACTTCGTCCCGGAGAGCTTCGACCGGGACAAGACCATCGCCCTGATCA
TGAACAGCAGCGGCAGCACCGGCCTGCCGAAGGGGGTGGCCCTGCCGCACCGGACCGCCT
GCGTGCGCTTCTCGCACGCCCGGGACCCCATCTTCGGCAACCAGATCATCCCGGACACCG
CCATCCTGAGCGTGGTGCCGTTCCACCACGGCTTCGGCATGTTCACGACCCTGGGCTACC
TCATCTGCGGCTTCCGGGTGGTCCTGATGTACCGGTTCGAGGAGGAGCTGTTCCTGCGGA
GCCTGCAGGACTACAAGATCCAGAGCGCGCTGCTCGTGCCGACCCTGTTCAGCTTCTTCG
CCAAGAGCACCCTGATCGACAAGTACGACCTGTCGAACCTGCACGAGATCGCCAGCGGGG
GCGCCCCGCTGAGCAAGGAGGTGGGCGAGGCCGTGGCCAAGCGGTTCCACCTCCCGGGCA
TCCGCCAGGGCTACGGCCTGACCGAGACCACGAGCGCGATCCTGATCACCCCCGAGGGGG
ACGACAAGCCGGGCGCCGTGGGCAAGGTGGTCCCGTTCTTCGAGGCCAAGGTGGTGGACC
TGGACACCGGCAAGACCCTGGGCGTGAACCAGCGGGGCGAGCTGTGCGTGCGGGGGCCGA
TGATCATGAGCGGCTACGTGAACAACCCGGAGGCCACCAACGCCCTCATCGACAAGGACG
GCTGGCTGCACAGCGGCGACATCGCCTACTGGGACGAGGACGAGCACTTCTTCATCGTCG
ACCGGCTGAAGTCGCTGATCAAGTACAAGGGCTACCAGGTGGCGCCGGCCGAGCTGGAGA
GCATCCTGCTCCAGCACCCCAACATCTTCGACGCCGGCGTGGCCGGGCTGCCGGACGACG
ACGCCGGCGAGCTGCCGGCCGCGGTGGTGGTGCTGGAGCACGGCAAGACCATGACGGAGA
AGGAGATCGTCGACTACGTGGCCAGCCAGGTGACCACCGCCAAGAAGCTGCGGGGCGGCG
TGGTGTTCGTGGACGAGGTCCCGAAGGGCCTGACCGGGAAGCTCGACGCCCGGAAGATCC
GCGAGATCCTGATCAAGGCCAAGAAGGGCGGCAAGATCGCCGTGTAAGACTAGTTATAAG
ACTGACTAGCCCGATGGGCCTCCCAACGGGCCCTCCTCCCCTCCTTGCACCGAGATTAAT
AAAAAAAAAAAAAAAAAAAAAAAAAAAAAAAAAAAAAAAAAAAAAAAAAAAAAAAAAAAA
AAAATGCATCAAAGGCTCTTTTCAGAGCCACCA

AIG1-PpLuc(GC)-ag-A64-histoneSL
(SEQ ID NO: 1477)

GGGCCGCCCAGCCGGTCCAGGCCTCTGGCGAACAAGCTTGAGGATGGAGGACGCCAAGAA
CATCAAGAAGGGCCCGGCGCCCTTCTACCCGCTGGAGGACGGGACCGCCGGCGAGCAGCT
CCACAAGGCCATGAAGCGGTACGCCCTGGTGCCGGGCACGATCGCCTTCACCGACGCCCA
CATCGAGGTCGACATCACCTACGCGGAGTACTTCGAGATGAGCGTGCGCCTGGCCGAGGC
CATGAAGCGGTACGGCCTGAACACCAACCACCGGATCGTGGTGTGCTCGGAGAACAGCCT
GCAGTTCTTCATGCCGGTGCTGGGCGCCCTCTTCATCGGCGTGGCCGTCGCCCCGGCGAA
CGACATCTACAACGAGCGGGAGCTGCTGAACAGCATGGGGATCAGCCAGCCGACCGTGGT
GTTCGTGAGCAAGAAGGGCCTGCAGAAGATCCTGAACGTGCAGAAGAAGCTGCCCATCAT
CCAGAAGATCATCATCATGGACAGCAAGACCGACTACCAGGGCTTCCAGTCGATGTACAC
GTTCGTGACCAGCCACCTCCCGCCGGGCTTCAACGAGTACGACTTCGTCCCGGAGAGCTT
CGACCGGGACAAGACCATCGCCCTGATCATGAACAGCAGCGGCAGCACCGGCCTGCCGAA
GGGGGTGGCCCTGCCGCACCGGACCGCCTGCGTGCGCTTCTCGCACGCCCGGGACCCCAT
CTTCGGCAACCAGATCATCCCGGACACCGCCATCCTGAGCGTGGTGCCGTTCCACCACGG
CTTCGGCATGTTCACGACCCTGGGCTACCTCATCTGCGGCTTCCGGGTGGTCCTGATGTA
CCGGTTCGAGGAGGAGCTGTTCCTGCGGAGCCTGCAGGACTACAAGATCCAGAGCGCGCT
GCTCGTGCCGACCCTGTTCAGCTTCTTCGCCAAGAGCACCCTGATCGACAAGTACGACCT
GTCGAACCTGCACGAGATCGCCAGCGGGGCGCCCCGCTGAGCAAGGAGGTGGGCGAGGC
CGTGGCCAAGCGGTTCCACCTCCCGGGCATCCGCCAGGGCTACGGCCTGACCGAGACCAC
GAGCGCGATCCTGATCACCCCCGAGGGGGACGACAAGCCGGGCGCCGTGGGCAAGGTGGT
CCCGTTCTTCGAGGCCAAGGTGGTGGACCTGGACACCGGCAAGACCCTGGGCGTGAACCA
GCGGGGCGAGCTGTGCGTGCGGGGGCCGATGATCATGAGCGGCTACGTGAACAACCCGGA
GGCCACCAACGCCCTCATCGACAAGGACGGCTGGCTGCACAGCGGCGACATCGCCTACTG
GGACGAGGACGAGCACTTCTTCATCGTCGACCGGCTGAAGTCGCTGATCAAGTACAAGGG
CTACCAGGTGGCGCCGGCCGAGCTGGAGAGCATCCTGCTCCAGCACCCCAACATCTTCGA
CGCCGGCGTGGCCGGGCTGCCGGACGACGACGCCGGCGAGCTGCCGGCCGCGGTGGTGGT
GCTGGAGCACGGCAAGACCATGACGGAGAAGGAGATCGTCGACTACGTGGCCAGCCAGGT
GACCACCGCCAAGAAGCTGCGGGGCGGCGTGGTGTTCGTGGACGAGGTCCCGAAGGGCCT
GACCGGGAAGCTCGACGCCCGGAAGATCCGCGAGATCCTGATCAAGGCCAAGAAGGGCGG
CAAGATCGCCGTGTAAGACTAGTTATAAGACTGACTAGCCCGATGGGCCTCCCAACGGGC
CCTCCTCCCCTCCTTGCACCGAGATTAATAAAAAAAAAAAAAAAAAAAAAAAAAAAAAAA

-continued

AAAAAAAAAAAAAAAAAAAAAAAAAAAAAAAAAAATGCATCAAAGGCTCTTTTCAGAGCCAC
CA

COX6C-PpLuc(GC)-ag-A64-histoneSL (SEQ ID NO: 1478)

GGAGTCAGGAAGGACGTTGGTGTTGAGGTTAGCATACGTATCAAGGACAGTAACTACCAA
GCTTGAGGATGGAGGACGCCAAGAACATCAAGAAGGGCCCGGCGCCCTTCTACCCGCTGG
AGGACGGGACCGCCGGCGAGCAGCTCCACAAGGCCATGAAGCGGTACGCCCTGGTGCCGG
GCACGATCGCCTTCACCGACGCCCACATCGAGGTCGACATCACCTACGCGGAGTACTTCG
AGATGAGCGTGCGCCTGGCCGAGGCCATGAAGCGGTACGGCCTGAACACCAACCACCGGA
TCGTGGTGTGCTCGGAGAACAGCCTGCAGTTCTTCATGCCGGTGCTGGGCGCCCTCTTCA
TCGGCGTGGCCGTCGCCCCGGCGAACGACATCTACAACGAGCGGGAGCTGCTGAACAGCA
TGGGGATCAGCCAGCCGACCGTGGTGTTCGTGAGCAAGAAGGGCCTGCAGAAGATCCTGA
ACGTGCAGAAGAAGCTGCCCATCATCCAGAAGATCATCATCATGGACAGCAAGACCGACT
ACCAGGGCTTCCAGTCGATGTACACGTTCGTGACCAGCCACCTCCCGCCGGGCTTCAACG
AGTACGACTTCGTCCCGGAGAGCTTCGACCGGGACAAGACCATCGCCCTGATCATGAACA
GCAGCGGCAGCACCGGCCTGCCGAAGGGGGTGGCCCTGCCGCACCGGACCGCCTGCGTGC
GCTTCTCGCACGCCCGGGACCCCATCTTCGGCAACCAGATCATCCCGGACACCGCCATCC
TGAGCGTGGTGCCGTTCCACCACGGCTTCGGCATGTTCACGACCCTGGGCTACCTCATCT
GCGGCTTCCGGGTGGTCCTGATGTACCGGTTCGAGGAGGAGCTGTTCCTGCGGAGCCTGC
AGGACTACAAGATCCAGAGCGCGCTGCTCGTGCCGACCCTGTTCAGCTTCTTCGCCAAGA
GCACCCTGATCGACAAGTACGACCTGTCGAACCTGCACGAGATCGCCAGCGGGGGCGCCC
CGCTGAGCAAGGAGGTGGGCGAGGCCGTGGCCAAGCGGTTCCACCTCCCGGGCATCCGCC
AGGGCTACGGCCTGACCGAGACCACGAGCGCGATCCTGATCACCCCCGAGGGGGACGACA
AGCCGGGCGCCGTGGGCAAGGTGGTCCCGTTCTTCGAGGCCAAGGTGGTGGACCTGGACA
CCGGCAAGACCCTGGGCGTGAACCAGCGGGGCGAGCTGTGCGTGCGGGGGCCGATGATCA
TGAGCGGCTACGTGAACAACCCGGAGGCCACCAACGCCCTCATCGACAAGGACGGCTGGC
TGCACAGCGGCGACATCGCCTACTGGGACGAGGACGAGCACTTCTTCATCGTCGACCGGC
TGAAGTCGCTGATCAAGTACAAGGGCTACCAGGTGGCGCCGGCCGAGCTGGAGAGCATCC
TGCTCCAGCACCCCAACATCTTCGACGCCGGCGTGGCCGGCGTGCCGGACGACGACGCCG
GCGAGCTGCCGGCCGCGGTGGTGGTGCTGGAGCACGGCAAGACCATGACGGAGAAGGAGA
TCGTCGACTACGTGGCCAGCCAGGTGACCACCGCCAAGAAGCTGCGGGGCGGCGTGGTGT
TCGTGGACGAGGTCCCGAAGGGCCTGACCGGGAAGCTCGACGCCCGGAAGATCCGCGAGA
TCCTGATCAAGGCCAAGAAGGGCGGCAAGATCGCCGTGTAAGACTAGTTATAAGACTGAC
TAGCCCGATGGGCCTCCCAACGGGCCCTCCTCCCCTCCTTGCACCGAGATTAATAAAAAA
AAAAAAAAAAAAAAAAAAAAAAAAAAAAAAAAAAAAAAAAAAAAAAAAAAAAAAAAAAAA
TGCATCAAAGGCTCTTTTCAGAGCCACCA

ASAH1-PpLuc(GC)-ag-A64-histoneSL (SEQ ID NO: 1479)

GGGCCTCTGCTGGAGTCCGGGGAGTGGCGTTGGCTGCTAGAGCGAAGCTTGAGGATGGAG
GACGCCAAGAACATCAAGAAGGGCCCGGCGCCCTTCTACCCGCTGGAGGACGGGACCGCC
GGCGAGCAGCTCCACAAGGCCATGAAGCGGTACGCCCTGGTGCCGGGCACGATCGCCTTC
ACCGACGCCCACATCGAGGTCGACATCACCTACGCGGAGTACTTCGAGATGAGCGTGCGC
CTGGCCGAGGCCATGAAGCGGTACGGCCTGAACACCAACCACCGGATCGTGGTGTGCTCG
GAGAACAGCCTGCAGTTCTTCATGCCGGTGCTGGGCGCCCTCTTCATCGGCGTGGCCGTC
GCCCCGGCGAACGACATCTACAACGAGCGGGAGCTGCTGAACAGCATGGGGATCAGCCAG
CCGACCGTGGTGTTCGTGAGCAAGAAGGGCCTGCAGAAGATCCTGAACGTGCAGAAGAAG
CTGCCCATCATCCAGAAGATCATCATCATGGACAGCAAGACCGACTACCAGGGCTTCCAG
TCGATGTACACGTTCGTGACCAGCCACCTCCCGCCGGGCTTCAACGAGTACGACTTCGTC
CCGGAGAGCTTCGACCGGGACAAGACCATCGCCCTGATCATGAACAGCAGCGGCAGCACC
GGCCTGCCGAAGGGGGTGGCCCTGCCGCACCGGACCGCCTGCGTGCGCTTCTCGCACGCC
CGGGACCCCATCTTCGGCAACCAGATCATCCCGGACACCGCCATCCTGAGCGTGGTGCCG
TTCCACCACGGCTTCGGCATGTTCACGACCCTGGGCTACCTCATCTGCGGCTTCCGGGTG
GTCCTGATGTACCGGTTCGAGGAGGAGCTGTTCCTGCGGAGCCTGCAGGACTACAAGATC
CAGAGCGCGCTGCTCGTGCCGACCCTGTTCAGCTTCTTCGCCAAGAGCACCCTGATCGAC
AAGTACGACCTGTCGAACCTGCACGAGATCGCCAGCGGGGGCGCCCCGCTGAGCAAGGAG
GTGGGCGAGGCCGTGGCCAAGCGGTTCCACCTCCCGGGCATCCGCCAGGGCTACGGCCTG
ACCGAGACCACGAGCGCGATCCTGATCACCCCCGAGGGGGACGACAAGCCGGGCGCCGTG
GGCAAGGTGGTCCCGTTCTTCGAGGCCAAGGTGGTGGACCTGGACACCGGCAAGACCCTG
GGCGTGAACCAGCGGGGCGAGCTGTGCGTGCGGGGGCCGATGATCATGAGCGGCTACGTG
AACAACCCGGAGGCCACCAACGCCCTCATCGACAAGGACGGCTGGCTGCACAGCGGCGAC
ATCGCCTACTGGGACGAGGACGAGCACTTCTTCATCGTCGACCGGCTGAAGTCGCTGATC
AAGTACAAGGGCTACCAGGTGGCGCCGGCCGAGCTGGAGAGCATCCTGCTCCAGCACCCC
AACATCTTCGACGCCGGCGTGGCCGGCTGCCGGACGACGACGCCGGCGAGCTGCCGGCC
GCGGTGGTGGTGCTGGAGCACGGCAAGACCATGACGGAGAAGGAGATCGTCGACTACGTG
GCCAGCCAGGTGACCACCGCCAAGAAGCTGCGGGGCGGCGTGGTGTTCGTGGACGAGGTC
CCGAAGGGCCTGACCGGGAAGCTCGACGCCCGGAAGATCCGCGAGATCCTGATCAAGGCC
AAGAAGGGCGGCAAGATCGCCGTGTAAGACTAGTTATAAGACTGACTAGCCCGATGGGCC
TCCCAACGGGCCCTCCTCCCCTCCTTGCACCGAGATTAATAAAAAAAAAAAAAAAAAAAA
AAAAAAAAAAAAAAAAAAAAAAAAAAAAAAAAAAAAAAAAAAATGCATCAAAGGCTCTT
TTCAGAGCCACCA

RPL32-PpLuc(GC)-ag-A64-histoneSL (SEQ ID NO: 1480)

GGGGCGCTGCCTACGGAGGTGGCAGCCATCTCCTTCTCGGCATCAAGCTTGAGGATGGAG
GACGCCAAGAACATCAAGAAGGGCCCGGCGCCCTTCTACCCGCTGGAGGACGGGACCGCC
GGCGAGCAGCTCCACAAGGCCATGAAGCGGTACGCCCTGGTGCCGGGCACGATCGCCTTC
ACCGACGCCCACATCGAGGTCGACATCACCTACGCGGAGTACTTCGAGATGAGCGTGCGC
CTGGCCGAGGCCATGAAGCGGTACGGCCTGAACACCAACCACCGGATCGTGGTGTGCTCG
GAGAACAGCCTGCAGTTCTTCATGCCGGTGCTGGGCGCCCTCTTCATCGGCGTGGCCGTC

-continued
```
GCCCCGGCGAACGACATCTACAACGAGCGGGAGCTGCTGAACAGCATGGGGATCAGCCAG
CCGACCGTGGTGTTCGTGAGCAAGAAGGGCCTGCAGAAGATCCTGAACGTGCAGAAGAAG
CTGCCCATCATCCAGAAGATCATCATCATGGACAGCAAGACCGACTACCAGGGCTTCCAG
TCGATGTACACGTTCGTGACCAGCCACCTCCCGCCGGGCTTCAACGAGTACGACTTCGTC
CCGGAGAGCTTCGACCGGGACAAGACCATCGCCCTGATCATGAACAGCAGCGGCAGCACC
GGCCTGCCGAAGGGGGTGGCCCTGCCGCACCGGACCGCCTGCGTGCGCTTCTCGCACGCC
CGGGACCCCATCTTCGGCAACCAGATCATCCCGGACACCGCCATCCTGAGCGTGGTGCCG
TTCCACCACGGCTTCGGCATGTTCACGACCCTGGGCTACCTCATCTGCGGCTTCCGGGTG
GTCCTGATGTACCGGTTCGAGGAGGAGCTGTTCCTGCGGAGCCTGCAGGACTACAAGATC
CAGAGCGCGCTGCTCGTGCCGACCCTGTTCAGCTTCTTCGCCAAGAGCACCCTGATCGAC
AAGTACGACCTGTCGAACCTGCACGAGATCGCCAGCGGGGGCGCCCCGCTGAGCAAGGAG
GTGGGCGAGGCCGTGGCCAAGCGGTTCCACCTCCCGGGCATCCGCCAGGGCTACGGCCTG
ACCGAGACCACGAGCGCGATCCTGATCACCCCCGAGGGGGACGACAAGCCGGGCGCCGTG
GGCAAGGTGGTCCCGTTCTTCGAGGCCAAGGTGGTGGACCTGGACACCGGCAAGACCCTG
GGCGTGAACCAGCGGGGCGAGCTGTGCGTGCGGGGCCGATGATCATGAGCGGCTACGTG
AACAACCCGGAGGCCACCAACGCCCTCATCGACAAGGACGGCTGGCTGCACAGCGGCGAC
ATCGCCTACTGGGACGAGGACGAGCACTTCTTCATCGTCGACCGGCTGAAGTCGCTGATC
AAGTACAAGGGCTACCAGGTGGCGCCGGCCGAGCTGGAGAGCATCCTGCTCCAGCACCCC
AACATCTTCGACGCCGGCGTGGCCGGGCTGCCGGACGACGACGCCGGCGAGCTGCCGGCC
GCGGTGGTGGTGCTGGAGCACGGCAAGACCATGACGGAGAAGGAGATCGTCGACTACGTG
GCCAGCCAGGTGACCACCGCCAAGAAGCTGCGGGCGGCGTGGTGTTCGTGGACGAGGTC
CCGAAGGGCCTGACCGGGAAGCTCGACGCCCGGAAGATCCGCGAGATCCTGATCAAGGCC
AAGAAGGGCGGCAAGATCGCCGTGTAAGACTAGTTATAAGACTGACTAGCCCGATGGGCC
TCCCAACGGGCCCTCCTCCCCTCCTTGCACCGAGATTAATAAAAAAAAAAAAAAAAAAAA
AAAAAAAAAAAAAAAAAAAAAAAAAAAAAAAAAAAAAAAAAAAAAATGCATCAAAGGCTCTT
TTCAGAGCCACCA
```

RPL32-PpLuc(GC)-albumin7-A64-C30-histoneSL (SEQ ID NO: 1481)

```
GGGGCGCTGCCTACGGAGGTGGCAGCCATCTCCTTCTCGGCATCAAGCTTGAGGATGGAG
GACGCCAAGAACATCAAGAAGGGCCCGGCGCCCTTCTACCCGCTGGAGGACGGGACCGCC
GGCGAGCAGCTCCACAAGGCCATGAAGCGGTACGCCCTGGTGCCGGGCACGATCGCCTTC
ACCGACGCCCACATCGAGGTCGACATCACCTACGCGGAGTACTTCGAGATGAGCGTGCGC
CTGGCCGAGGCCATGAAGCGGTACGGCCTGAACACCAACCACCGGATCGTGGTGTGCTCG
GAGAACAGCCTGCAGTTCTTCATGCCGGTGCTGGGCGCCCTCTTCATCGGCGTGGCCGTC
GCCCCGGCGAACGACATCTACAACGAGCGGGAGCTGCTGAACAGCATGGGGATCAGCCAG
CCGACCGTGGTGTTCGTGAGCAAGAAGGGCCTGCAGAAGATCCTGAACGTGCAGAAGAAG
CTGCCCATCATCCAGAAGATCATCATCATGGACAGCAAGACCGACTACCAGGGCTTCCAG
TCGATGTACACGTTCGTGACCAGCCACCTCCCGCCGGGCTTCAACGAGTACGACTTCGTC
CCGGAGAGCTTCGACCGGGACAAGACCATCGCCCTGATCATGAACAGCAGCGGCAGCACC
GGCCTGCCGAAGGGGGTGGCCCTGCCGCACCGGACCGCCTGCGTGCGCTTCTCGCACGCC
CGGGACCCCATCTTCGGCAACCAGATCATCCCGGACACCGCCATCCTGAGCGTGGTGCCG
TTCCACCACGGCTTCGGCATGTTCACGACCCTGGGCTACCTCATCTGCGGCTTCCGGGTG
GTCCTGATGTACCGGTTCGAGGAGGAGCTGTTCCTGCGGAGCCTGCAGGACTACAAGATC
CAGAGCGCGCTGCTCGTGCCGACCCTGTTCAGCTTCTTCGCCAAGAGCACCCTGATCGAC
AAGTACGACCTGTCGAACCTGCACGAGATCGCCAGCGGGGGCGCCCCGCTGAGCAAGGAG
GTGGGCGAGGCCGTGGCCAAGCGGTTCCACCTCCCGGGCATCCGCCAGGGCTACGGCCTG
ACCGAGACCACGAGCGCGATCCTGATCACCCCCGAGGGGGACGACAAGCCGGGCGCCGTG
GGCAAGGTGGTCCCGTTCTTCGAGGCCAAGGTGGTGGACCTGGACACCGGCAAGACCCTG
GGCGTGAACCAGCGGGGCGAGCTGTGCGTGCGGGGCCGATGATCATGAGCGGCTACGTG
AACAACCCGGAGGCCACCAACGCCCTCATCGACAAGGACGGCTGGCTGCACAGCGGCGAC
ATCGCCTACTGGGACGAGGACGAGCACTTCTTCATCGTCGACCGGCTGAAGTCGCTGATC
AAGTACAAGGGCTACCAGGTGGCGCCGGCCGAGCTGGAGAGCATCCTGCTCCAGCACCCC
AACATCTTCGACGCCGGCGTGGCCGGGCTGCCGGACGACGACGCCGGCGAGCTGCCGGCC
GCGGTGGTGGTGCTGGAGCACGGCAAGACCATGACGGAGAAGGAGATCGTCGACTACGTG
GCCAGCCAGGTGACCACCGCCAAGAAGCTGCGGGCGGCGTGGTGTTCGTGGACGAGGTC
CCGAAGGGCCTGACCGGGAAGCTCGACGCCCGGAAGATCCGCGAGATCCTGATCAAGGCC
AAGAAGGGCGGCAAGATCGCCGTGTAAGACTAGTGCATCACATTTAAAAGCATCTCAGCC
TACCATGAGAATAAGAGAAAGAAAATGAAGATCAATAGCTTATTCATCTCTTTTTCTTTT
TCGTTGGTGTAAAGCCAACACCCTGTCTAAAAAACATAAATTTCTTTAATCATTTTGCCT
CTTTTCTCTGTGCTTCAATTAATAAAAAATGGAAAGAACCTAGATCTAAAAAAAAAAAA
AAAAAAAAAAAAAAAAAAAAAAAAAAAAAAAAAAAAAAAAAAAAAAAAAATGCATCCCC
CCCCCCCCCCCCCCCCCCCCCCCCCCAAAGGCTCTTTTCAGAGCCACCAGAATT
```

SEQUENCE LISTING (1481 sequences)

SEQ ID NO: 1 - DNA, 21 bp, Homo sapiens
gctccttctttctgcaacatg

SEQ ID NO: 2 - DNA, 108 bp, Homo sapiens
ggctctctttccgcgctgcggtcagcctcggcgtcccacagagagggccagaggtggaaacgcagaaaaccaaaccaggactatcagagattgcccggagaggggatg

SEQ ID NO: 3 - DNA, 69 bp, Homo sapiens
cttcctcttcttgatcggggattcaggaaggagcccaggagcagaggaagtagagagagagacaacatg

SEQ ID NO: 4 - DNA, 159 bp, Homo sapiens
tgtccttcctctctggactgtaagaatatgtctccagggccagtgtctgctgcgatcgagtcccaccttccaagtcctggcatctcaatgcatctgggaagctacctgcattaagtcaggactgagcacacaggtgaactccagaaagaagaagctatg

SEQ ID NO: 5 - DNA, 57 bp, Homo sapiens
tgaccttttccctcccgcggctctctacctctcgccgcccctagggaggacaccatg

SEQ ID NO: 6 - DNA, 168 bp, Homo sapiens
gggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatg

SEQ ID NO: 7 - DNA, 53 bp, Homo sapiens
agctcttctactccactgctgtctatcttgcctgccggcacccagccaccatg

SEQ ID NO: 8 - DNA, 89 bp, Homo sapiens
cttcctctacccggttggcaggcggcctggcccagccccttctctaaggaagcgcatttcctgcctccctgggccggccgggctggatg

SEQ ID NO: 9 - DNA, 28 bp, Homo sapiens
tcttctctctgctgctgtagctgccatg

SEQ ID NO: 10 - DNA, 246 bp, Homo sapiens
ctgtctttcttccgggaggcggtgacagctgctgagacgtgttgcagccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatg

SEQ ID NO: 11 - DNA, 211 bp, Homo sapiens
cgtcccctcgcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatg

SEQ ID NO: 12 - DNA, 40 bp, Homo sapiens
ccgcctccctgggcgccggagtcatgtgacccacacaatg

SEQ ID NO: 13 - DNA, 181 bp, Homo sapiens
ttttctttcattagggggaaggcgtgaggaaagtaccaaacagcagcggagttttaaactttaaatagacaggtctgagtgcctgaacttgccttttcattttacttcatcctccaaggagttcaatcacttggcgtgacttcactacttttaagcaaaagagtggtgcccaggcaacatg

SEQ ID NO: 14 - DNA, 68 bp, Homo sapiens
cattctctgggaaagggcagcagcagccaggtgtggcagtgacagggaggtgtgaatgaggcaggatg

SEQ ID NO: 15 - DNA, 55 bp, Homo sapiens
cgctccttcctcctcggctcgcgtctcactcagtgtaccttctagtcccgccatg

SEQ ID NO: 16 - DNA, 22 bp, Homo sapiens
ctgtcctcttcagctcaagatg

SEQ ID NO: 17 - DNA, 111 bp, Homo sapiens
gggccctttctgggcaggacccgccccttggtcccgcagagccttggtacttggacctgaaccttgctccgagagggagtcctcgcggacgtcagccaagattccagaatg

SEQ ID NO: 18 - DNA, 113 bp, Homo sapiens
cttccttttgcagcaagttctttcctgcactaatcacaattcttggaagaggagaactggacgttgtgaacagagttagctggtaaatgtcctcttaaaagatccaaaaaatg

SEQ ID NO: 19 - DNA, 146 bp, Homo sapiens
agccctttctccagggacagttgctgaagcttcatcctttgctctcattctgtaagtcatagaaaagtttgaaacattctgtctgtggtagagctcgggccagctgtagttcattcgccagtgtgcttttcttaatatctaagatg

SEQ ID NO: 20 - DNA, 79 bp, Homo sapiens
ggtcccctatccgcaccccggcccctgagagctggcactgcgactcgagacagcggcccggcaggacagctccagaatg

SEQ ID NO: 21 - DNA, 178 bp, Homo sapiens
ccccctcttcctcctcctcaagggaaagctgcccacttctagctgccctgccatcccctttaaagggcgacttgctcagcgccaaaccgcggctccagccctctccagcctccggctcagccggctcatcagtcggtccgcgccttgcagctcctccagagggacgcgccccgagatg

SEQ ID NO: 22 - DNA, 21 bp, Homo sapiens
ggctcttctggcgccaaaatg

SEQ ID NO: 23 - DNA, 170 bp, Homo sapiens
cttccttcctgaccggcgcgcgcagcctgctgccgcggtcagcgcctgctcctgctcctccgctcctcctgcgcggggtgctgaaacagcccggggaagtagagccgcctccggggagcccaaccagccgaacgccgccggcgtcagcagccttgcgcggccacagcatg

SEQ ID NO: 24 - DNA, 615 bp, Homo sapiens
gcgcctctcttccgccaggcatcccagaggtcctggtggtttcatttccgggtgcggcttctgtcataaagcggagacctcccttcaaacgtggcgtcgtgggttgtttgcgcctcgcctggggtcagcgagcaaggacgggcgcgggcggggatactcaaagccaacagctggagtcagcccttgtgtcccgggctcacagtggcacgactgaatcctcagagtcggctggcttttgagctctcacgattggggaggagggggcgtttctggttcgcagctccagaggattgcgttccttcccccatacctgtcccccacagtcacgctctgccctgacgtgcagcatttgacaagttaccccctcgccacatactacttccacccacgtccgagttaactttgttcttaaccttcttgagactaccctcggcctccaggtctttttttcccagttcatttttgcccataagattgagtttcgagtttcagatatcatgcagaaagtttacctttaagactgagcacccatctgatactcttcctcccgaaaaagttcatgctcacgagagagtttgtgggaaaagtgaaagccagtacacgcaggaaactatg

SEQ ID NO: 25 - DNA, 38 bp, Homo sapiens
cgctccttcaccctcctcgttggtgtcctgtcaccatg

SEQ ID NO: 26 - DNA, 177 bp, Homo sapiens
gagccttcttgtcagcatctgttagtggaggttgggaagcctctcctccttccccctccctctttgcctccacctggctcctccccatgttcgtccatcacccctcccccctttcccaaggacaatctgcaagaaagcagcggcggaggagagctaagactaaaagagtggatcatg

SEQ ID NO: 27 - DNA, 54 bp, Homo sapiens
ctgtctcctcagcttcaggcaccaccactgacctgggacagtgaatcgacaatg

SEQ ID NO: 28 - DNA, 848 bp, Homo sapiens
agttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatg

SEQ ID NO: 29 - DNA, 50 bp, Homo sapiens
cctcccttactgcaggaaggcactccgaagacataagtcggtgagacatg

SEQ ID NO: 30 - DNA, 58 bp, Homo sapiens
ccgcctcccactccccagcgcccccggaccgtgcagttctctgcaggaccaggccatg

SEQ ID NO: 31 - DNA, 187 bp, Homo sapiens
gtttctcccagcctcagcctccccgccgccgccgccgccgccgccgccgagccggtttcctttttccggcgctccgggtgcgagagacaggtcgggccccctaggcagcgagccgcagcgcaatcccggcgctcgcccaaggaccctggaagctaccgttaccccgccgggcagcgtgggcgccatg

SEQ ID NO: 32 - DNA, 143 bp, Homo sapiens
cctcctcctcttacccaaattttccagccgatcactggagctgacttccgcaatcccgatggaataaatctagcacccctgatggtgtgcccacactttgctgccgaaacgaagccagacaacagatttccatcagcaggatg

SEQ ID NO: 33 - DNA, 95 bp, Homo sapiens
gcttctttgcgtaaccaatactggaaggcatttaaaggcacctctgccgccacagaccttgcagttaactccgccctgacccacccttcccgatg

SEQ ID NO: 34 - DNA, 77 bp, Homo sapiens
ccgcctcctcctgtcccgcagtcggcgtccagcggctctgcttgttcgtgtgtgtgtcgttgcaggccttattcatg

SEQ ID NO: 35 - DNA, 254 bp, Homo sapiens
ctctctctgcttctttccttttctctctcatggtagggttatgagtcagttgccaaaaggtggggacatttcctgatgcatttgcaacactgagaagttatcttaagggaggctgggccccattctactcatctggcccagaaagtgaacaccttgggggccactaaggcagccctgctaggggagacgctccaacctgtcttctctctgtctcctggcagctctcttggcctcctagtttctacctaatcatg

SEQ ID NO: 36 - DNA, 31 bp, Homo sapiens
cagcctcctcctgcctcaccgcccgaagatg

SEQ ID NO: 37 - DNA, 314 bp, Homo sapiens
ccgccccttctcgagaactcgcagagctgggctggtaaaattgcagtgctgaagacactggacccgcaaaaggctgtccctcccaaacctgggattctgggctcactgagttcacctgcgagtcagccctacctgcactgctctggtctagtacaaacaggctgctggcattgagggacggagtctccaactcctggcctctagcagtcctcctgtgtaggtctcccaaagtgctagtgtgtccggaattggtgggttcttggtctcactgacttcaagaatgaagccgcggaccctcgcagtctgctacaatg

SEQ ID NO: 38 - DNA, 39 bp, Homo sapiens
ttttctcttctgtcaaccccacacgcctttggcacaatg

SEQ ID NO: 39 - DNA, 335 bp, Homo sapiens
ctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccggtactgtcgggccccggccctctggagcttcaggaggcggccgtcagggtcggggagtatttgggtccggggtctcagggaagggcggcgcctgggtctgcggtatcggaaagagcctgctggagccaagtagccctccctctcttgggacagacccctcggtcccatg

SEQ ID NO: 40 - DNA, 98 bp, Homo sapiens
ctccctccctctttccctcacagccgacgaggcaacaattaggctttggggataaaacgaggtgcggagagcgggctggggcatttctccccgagatg

SEQ ID NO: 41 - DNA, 41 bp, Homo sapiens
cactcttctggtccccacagactcagagagaacccaccatg

SEQ ID NO: 42 - DNA, 84 bp, Homo sapiens
cttcctctgatccgggccgggcgggaagtcgggtcccgaggctccggctcggcagaccgggcggaaagcagccgagcggccatg

SEQ ID NO: 43 - DNA, 48 bp, Homo sapiens
cggcctttccagggccggggaaccccaggaggaagctgctgagccatg

SEQ ID NO: 44 - DNA, 166 bp, Homo sapiens
cactctctttacagtcagccttctgcttgccacagtcatagtgggcagtcagtgaatcttccccaagtgctgacaattaatacctggtttagcggcaaagattcagagaggcgtgagcagcccctctggccttcagacaaaaatctacgtaccatcagaaactatg

SEQ ID NO: 45 - DNA, 132 bp, Homo sapiens
tctccttttacacaaatagccccggatatctgtgttaccagccttgtctcggccacctcaaggataatcactaaattctgccgaaaggactgaggaacggtgcctggaaaagggcaagaatatcacggcatg

SEQ ID NO: 46 - DNA, 59 bp, Homo sapiens
tggtccctttagggctccggatatctttggtgacttgtccactccagtgtggcatcatg

SEQ ID NO: 47 - DNA, 87 bp, Homo sapiens
aaacctcttcgaggcacaaggcacaacaggctgctctgggattctcttcagccaatcttcattgctcaagtgtctgaagcagccatg

SEQ ID NO: 48 - DNA, 209 bp, Homo sapiens
ctgtctctcttcatttaagcacgactctgcagaaggaacaaagcaccctccccactgggctcctggttgcagagctccaagtcctcacacagatacgcctgtttgagaagcagcgggcaagaaagacgcaagcccagaggccctgccatttctgtgggctcaggtccctactggctcaggcccctgcctccctcggcaaggccacaatg

SEQ ID NO: 49 - DNA, 185 bp, Homo sapiens
agccctctgccctttctgagcccgagggactgccacctccactgtgtgcacactcagctacgggacacatttcaggtatccaaggcagcagaggtgagtgggtcccccgagctctgtgaccttatgctccacactaactctggcagagcctccgtttcctcatagaacaaagaacagccaccatg

SEQ ID NO: 50 - DNA, 111 bp, Homo sapiens
tgccctccttccctgtctctgcctctccctcccttcctcaggcatcagagcggagacttcagggagaccagagcccagcttgccaggcactgagctagaagccctgccatg

SEQ ID NO: 51 - DNA, 72 bp, Homo sapiens
ccgcccctcccgcggccccgcccctcccgcggcccgtcagcctctgccgcggagctgcgtccgccactcatg

SEQ ID NO: 52 - DNA, 123 bp, Homo sapiens
cttcctttaaaatcctataaaatcagaagcccaagtctccactgccagtgtgaaatcttcagagaagaatttctctttagttctttgcaagaaggtagagataaagacactttttcaaaaatg

SEQ ID NO: 53 - DNA, 60 bp, Homo sapiens
ttttctctctgattctccagcgacaggacccggcgccgggcactgagcaccgccaccatg

SEQ ID NO: 54 - DNA, 110 bp, Homo sapiens
ctttctctgtctgccagggtctccgactgtcccagacgggctggtgtgggcttgggatcctcctggtgacctctcccgctaaggtccctcagccactctgccccaagatg

SEQ ID NO: 55 - DNA, 151 bp, Homo sapiens
ccctccttcgcgctctctcgctccctgccgccgcccgcagggctgcggggctcggtggcatctcccgggcgcggcccgcagtccttgcccctgcctccgggccgctcccgcccccggcgccgctcgctcccccgacccggactcccccatg

SEQ ID NO: 56 - DNA, 85 bp, Homo sapiens
gtgcctctgtggccgcaggcgcaggcccgggcgacagccgagacgtggagcgcgccggctcgctgcagctccgggactcaacatg

SEQ ID NO: 57 - DNA, 71 bp, Homo sapiens
gcttctctcgttccgtcgattgggaggagcggtggcgacctcggccttcagtgtttccgacggagtgaatg

SEQ ID NO: 58 - DNA, 234 bp, Homo sapiens
atctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgagcctgtttctgcgccggaccagtcgaggactctggacagtagaggccccgggacgaccgagctgatg

SEQ ID NO: 59 - DNA, 67 bp, Homo sapiens
aattctcctggcggcctccgttcagacgcggcagctgtgacccacctgcctcctccgcagagcaatg

SEQ ID NO: 60 - DNA, 493 bp, Homo sapiens
tcccctctttccccaacctcctccctctcttctactccacccctccgttttcccactccccactgactcggatgcctggatgttctgccaccgggcagtggtccagcgtgcagccgggagggggcaggggcagggggcactgtgacaggaagctgcgcgcacaagttggccatttcgagggcaaaataagttctcccttggatttggaaaggacaaagccagtaagctacctcttttgtgtcggatgaggaggaccaaccatgagccagagcccgggtgcaggctcaccgccgccgctgccaccgcggtcagctccagttcctgccaggagttgtcggtgcgaggaattttgtgacaggctctgttagtctgttcctcccttatttgaaggacaggccaaagatccagtttggaaatgagagaggactagcatgacacattggctccaccattgatatctcccagaggtacagaaacaggattcatgaagatg

SEQ ID NO: 61 - DNA, 864 bp, Homo sapiens
ggttcctttggggtgatcaaagagggagacacagacacagagagacaaaggcaaggaggactgtctgggagccacgcgggcgatacagtttccgaggcacgccgcgtcccgcctagcctgttgaacaggtagacatgagcgacccaagctgcggatttgcgaggcgcgccctggagctgctagagatccggaagcacagccccgaggtgtgcgaagccaccaagtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatg

SEQ ID NO: 62 - DNA, 111 bp, Homo sapiens
ggctccttccgctccgcgactgcgttaactggagccaggctgagcgtcggcgccggggttcggtggcctctagtgagatctggaggatccaaggattctgtagctacaatg

SEQ ID NO: 63 - DNA, 55 bp, Homo sapiens
aggtctctgcggcgcggtcctcggagacacgcggcggtgtcctgtgttggccatg

SEQ ID NO: 64 - DNA, 140 bp, Homo sapiens
acttcctttcccggcgtgcaccgcgaatccctcctcctcttctttacctctctccctcctcctcaggttctctatcgacgagtctggtagctgagcgttgggctgtaggtcgctgtgctgtgtgatcccccagagccatg

SEQ ID NO: 65 - DNA, 198 bp, Homo sapiens
ccttctttaataagcaggagcgaaaaagacaaattccaaagaggattgttcagttcaagggaatgaagaattcagaataattttggtaaatggattccaatatggggaataagaataagctgaacagttgacctgctttgaagaaacatactgtccatttgtctaaaataatctataacaaccaaaccaatcaaaatg

SEQ ID NO: 66 - DNA, 49 bp, Homo sapiens
cggcccctctgttgtcgtttggcagcggatagaggacacgaccaagatg

SEQ ID NO: 67 - DNA, 113 bp, Homo sapiens
cttccctttcctgttaggcgagagctgcgaaaggcgagagctgcgaagggccaggtgtcgggcgctgtttctcgttttcatcatatagacaaaacagccctgctgcaaagatg

SEQ ID NO: 68 - DNA, 326 bp, Homo sapiens
gcttcttctcacgccgggagcaggctcccgcctcgcaccgctgccccgcgagcagctcctcttctcccgaggcgcgcggggcgcccccgcgagccccgcggctgagaccccgcagcctggaggagggctgtccggggctttggatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatg

SEQ ID NO: 69 - DNA, 342 bp, Homo sapiens
ccgcctctttcattgaagaaatttaagttcgtgtggttttaccttttccgggagtctccagctggccctcatttgtgtccggagctcaggagttcccaaaccgactcagtcgcaccaagtttccgtcttttggaattggggaaggagtttctttctttcttttcttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaaagccggagtattttactaagcccctaaaatg

SEQ ID NO: 70 - DNA, 186 bp, Homo sapiens
cctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatg

SEQ ID NO: 71 - DNA, 214 bp, Homo sapiens
ctgtctttatggaccagtaggcagagcgaaattgacgctgacaagacttttgcatcttggaagggactgtaatctactgtagtgaagaacagagcctctcaatcagacgggtgtaaataagagacggaggggagtccaaaagaaaaggaagaggaggaaaaacaagtgtgtgttggggggaacagggggaaaagcatttttggtggatggtatg

SEQ ID NO: 72 - DNA, 261 bp, Homo sapiens
gctcctttaagcgtccacaggcggcggagcggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatg

SEQ ID NO: 73 - DNA, 97 bp, Homo sapiens
ttttctctttcaaactgcccagacggttggacaggacgtagacacacagaagaaaagaagacaaagaacgggtaggaaaattaaaaaggttaccatg

SEQ ID NO: 74 - DNA, 97 bp, Homo sapiens
cagcctcttttgccggtattcagtgaagaaagcaagtctaaatatgcagttctctcactggagtgaaagatgttttgttcatttctaatcaactatg

SEQ ID NO: 75 - DNA, 472 bp, Homo sapiens
ccgcctctcggcgagcccgccctcttctgaagaggcgtttctggaccactgagccccgcctcccactgtgagcggaaccctaccgtttttaaaaaaatctttttcaaaacttgccaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcagcgaccatg

SEQ ID NO: 76 - DNA, 79 bp, Homo sapiens
tggccttcccggcggctgattcgagggcttgtttggtcagaaggggggcgtcagagaagctgccccttagccaaccatg

SEQ ID NO: 77 - DNA, 141 bp, Homo sapiens
gagtctttcggcctgggtggaggacgcggctgcttcaagtccttggctctgatccaggccacagattccaggattctacaggcaggaaacatcttagaaatcagggttgggcaggcaggagccaggagagtagctacaatg

SEQ ID NO: 78 - DNA, 217 bp, Homo sapiens
tatccttttttactgcagatttactttaaggctcatattctccaagtctattctgctttaaaaagaagacaagaaaagaagtggtttatcaaaatcacgttataatcagattttgaccaagcattttgtaagtatacaaatgtcagccaatgacatataacaaccatttcttataaaaccttgatgttcaaaagcctgactagcagtggcatccatg

SEQ ID NO: 79 - DNA, 181 bp, Homo sapiens
tgctcttttcgatccgggacggccggtcaggctcgccgccgagctggagaactacgatgacccgcacaaaacccctgcctccccagttgtccacatcaggggcctgattgacggtgtggtggaagcagaccttgtggaggccttgcaggagtttggacccatcagctatgtggtggtaatg

SEQ ID NO: 80 - DNA, 303 bp, Homo sapiens
cattcttccgggtccagaaggtgatctccgcccgtgctcagaatccaggggcccggggctgtagattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagagagaaacatg

SEQ ID NO: 81 - DNA, 289 bp, Homo sapiens
tggcctcctcttgccacgaggtcagacggcgagttcttagagaaaaaggctgcttagctgctgcttatcatgtaacctcaaaaggaaactgatcgtctttctcatgctgtcacgtacttgggttattatcgctgattacagctggaaacaattgatttgctcttacgtatttgtgtgacttgactcttcaaacacaaaggttaacaggaagatctcgagggccctggctgaacttcaccttttggctttcttggcctgatgctgaactctcgaggttgagccccatatg

SEQ ID NO: 82 - DNA, 172 bp, Homo sapiens
atccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatg

SEQ ID NO: 83 - DNA, 24 bp, Homo sapiens
ccgcctcctcgggagagataaatg

SEQ ID NO: 84 - DNA, 221 bp, Homo sapiens
gcgcccctttgtgcgtcacgggtggcgggcgcgggaaggggatttggattgttgcgcctctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgatg

SEQ ID NO: 85 - DNA, 222 bp, Homo sapiens
gcgtcttttcccccagccccgctccaccagatccgcgggagccccactgctctccgggtccttggcttgtggctgtgggtcccatcgggcccgccctcgcacgtcactccgggacccccgcggcctccgcaggttctgcgctccaggccggagtcagagactccaggatcggttctttcatcttcgccgcccctgcgcgtccagctcttctaagacgagatg

SEQ ID NO: 86 - DNA, 143 bp, Homo sapiens
aaccctttctgcagagtcccggcagtgcgggactccggtagccgcccctccggtagccgcccctcctgcccccgcgccgccgccctatatgttgcccgccgcggcctctggggcatggagcacgctgcccagccctggcgatg

SEQ ID NO: 87 - DNA, 99 bp, Homo sapiens
gttcccttttctacctgcagagcacggttcccataagggcggcgagatcagcctcctgtctcatctggaagaccaccactctggggtctcagaggaatg

SEQ ID NO: 88 - DNA, 50 bp, Homo sapiens
ctatctctgtgtgtccgcgtgtgcgcccggtccccgcctgccgcaccatg

SEQ ID NO: 89 - DNA, 310 bp, Homo sapiens
cctcctcctccagctcttcctgtcccgctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatg

SEQ ID NO: 90 - DNA, 84 bp, Homo sapiens
aggtctctgcgcagcccagcccgccggtccacgccgcgcaccgctccgagggccagcgccacccgctccgcagccggcaccatg

SEQ ID NO: 91 - DNA, 50 bp, Homo sapiens
tcgcctttgccgatccgccgcccgtccacacccgccgccagctcaccatg

SEQ ID NO: 92 - DNA, 107 bp, Homo sapiens
ggctccttcttcctctgcatgtggctggcggccgcagagcagttcagttcgctcactcctcgccggccgcctctccttcgggctctcctcgcgtcactggagccatg

SEQ ID NO: 93 - DNA, 52 bp, Homo sapiens
cgttctctgcctggcctgaggctccctgagccgcctccccaccatcaccatg

SEQ ID NO: 94 - DNA, 160 bp, Homo sapiens
gcctcctttctttctcagcccagacctggccctctggagagggttttggagtcctgggtaggcagggtacctcaggcagcaggcagcacaccttggatgtgagctgaatggattttcaaatttcacagaaggagcctccatgctggagaaagtatgtatg

SEQ ID NO: 95 - DNA, 126 bp, Homo sapiens
cggcctccctttagctgccatcttgcgtccccgcgtgtgtgcgcctaatctcaggtggtccacccgagaccccttgagcaccaaccctagtcccccgcgcggccccttattcgctccgacaagatg

SEQ ID NO: 96 - DNA, 43 bp, Homo sapiens
ttgtcctttgcatctgcacgtgttcgcagtcgtttccgcgatg

SEQ ID NO: 97 - DNA, 485 bp, Homo sapiens
tttcctttcttaatatggcgatgagctcttaggccagtgtggggaccggggctgaggtgccctggacactggaggagggggagggaaggagcccctgggagcctggggtagaagtgtaggaggtgggaggattccggcccgcatggagctgtcctggcctcagaaggttatccgtctctcctgccaaccatggagacatatttagacaggaccaggtggggactgaggggtgccaatttcagggggcagctccggttccctccccgccccctgctcctattcctccacctgaccctttttcccttggctctgtcggcagtttctccaggacccagcagtgccctctgtccactgctctgggccattccccaatcccccctcccacttgagcccctaactcagaatctgggacccaggggcccctccctaccccagctaacctcttctggaccaggagagccaacccagatcccactacctccatg

SEQ ID NO: 98 - DNA, 92 bp, Homo sapiens
gtctctctgcccctctctgccccaagtattttcagccccagccggccacacagctcggatctcctcctgtggatccccccagctctgcgatg

SEQ ID NO: 99 - DNA, 235 bp, Homo sapiens
aggtctttggctttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccaggcccaccgtggtgcacgcaaaccacttcctggccatg

SEQ ID NO: 100 - DNA, 92 bp, Homo sapiens
tttcctcctttccaagagagggctgagggagcagggttgagcaactggtgcagacagcctagctggactttgggtgaggcggttcagccatg

SEQ ID NO: 101 - DNA, 97 bp, Homo sapiens
gggtccctttctgtcccctgagcaccgtcgcctcctttcctccagggctccgtaggcaccaactgcaaggacccctccccctgcgggcgctcccatg

SEQ ID NO: 102 - DNA, 98 bp, Homo sapiens
gagcctctcctcaaagcctggctcccacggaaaatatgctcagtgcagccgcgtgcatgaatgaaaacgccgccgggcgcttctagtcggacaaaatg

SEQ ID NO: 103 - DNA, 380 bp, Homo sapiens
cgctcccttcgtttccgtctcggccgggcacccgagcgcatcccgccgaggccgggccgtttcagggggaggcgccaactcatcgcggcgccgggcccctgaccgtgcagtaaccgctacccaggaggcggagcggacaaggctccggcctgcgaggagtcacattaactttgctctagaagacaactttacaaggatctaaaaggaacaggattaaagatgactgaatactgggttccagaaatttaaaacaatcagcttagcaaatcatatattcttctgtggagctgagaattgatgtccgctcttccccgtgatttggaactttccaatcccagagaaaagttgacaaagggactgcccaggactgagtccatatg

SEQ ID NO: 104 - DNA, 94 bp, Homo sapiens
ccccccctcactcgcgcgttaggaggctcgggtcgttgtggtgcgctgtcttcccgcttgcgtcagggacctgcccgactcagtggccgccatg

SEQ ID NO: 105 - DNA, 211 bp, Homo sapiens
cctcctctcctctccctctcctctcctgctatagagggctccgacagcagttcccagccagcgtgttcagcctgcctgcctgcctgcctctgtgtgtgtgtgagcgtgtgtgcgtgcgtctactttgtactgggaagaacacagcccatgtgctctgcatggacgttactgatactctgtttagcttgattttcgaaaagcaggcaagatg

SEQ ID NO: 106 - DNA, 87 bp, Homo sapiens
ctgcctcttccagggcgggcggtgtggtgcacgcattgctgtgctccaactccctcagggcctgtgttgccgcactctgctgctatg

SEQ ID NO: 107 - DNA, 243 bp, Homo sapiens
cctcctccttctcccgccctcctcgccgatccgggcggtgctggcagccggagcggcggcgggcgggccgagcagccggggcagccgcgcgtgggcatccacgggcgccgagcctccgtccgtgtctctatccctcccgggcctttgtcagcgcgcccgctgggagcggggccgagagcgccggttccagtcagacagccccgcaggtcagcggccgggccgagggcgccagagggggccatg

SEQ ID NO: 108 - DNA, 506 bp, Homo sapiens
ttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaggataagcaagtcgaatttttgtcttacgctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatg

SEQ ID NO: 109 - DNA, 528 bp, Homo sapiens
ccgtcccctccagcccagctcgggctccagctccagcgccggcgcttcagctgcgaccgcgagccctctcaagcaagatataacttccccaagtcacacagtggtatcagagctaagaatgggacccagatatgactgatctagttctgttccaaaaccgtgctgtattatattaacgcctaccctctgaagaggtccaagcaacggaagtactactacgaagctgcctttctggccatccttgagaaaaatagacagatgagttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatg

SEQ ID NO: 110 - DNA, 163 bp, Homo sapiens
cgatctttctggagccgcacctccacgcggagtccgagcgcgtgtgctgagaccccagggtcgggagggcggagactgggagggagggagaagcccctttggcctgccttacggaagcctgcgagggagggtggtgtccactgcccagttccgtgtcccgatg

SEQ ID NO: 111 - DNA, 175 bp, Homo sapiens
agttcttctcgatcgtgtcagtttgtaaggcgagggcggaagttggattcctggcctgagaatattaggcgtagttttccagtttttggcaaagcggaaatacttaaggcccctgggttgactgggttctttgttttatctaccggcttctgctttacgacaggtcacaaacatg

SEQ ID NO: 112 - DNA, 97 bp, Homo sapiens
tttcctccccatcctgtcgcggctcgaaaggaatggaaaatggcggcctagacgcggagtttcctgcccgacccgcggcggctccggcggcgccatg

SEQ ID NO: 113 - DNA, 247 bp, Homo sapiens
ctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatg

SEQ ID NO: 114 - DNA, 107 bp, Homo sapiens
tgttctctttggcttccgggcgcacgctactctgtcgccgccgtcagaccggaattgccggtgccgccgccaccgctgtctgtgcgcccacctctgctgctaccatg

SEQ ID NO: 115 - DNA, 70 bp, Homo sapiens
cgttctttttcgcaacgggtttgccgccagaacacaggtgtcgtgaaaactacccctaaaagccaaaatg

SEQ ID NO: 116 - DNA, 89 bp, Homo sapiens
tctcctctttccccctcccttctctcccgggcggcttactttgcggcagcgccgagaaccccaccccctttctttgcggaatcaccatg

SEQ ID NO: 117 - DNA, 31 bp, Homo sapiens
atttccttcctcttttggcaacatggcgggc

SEQ ID NO: 118 - DNA, 35 bp, Homo sapiens
gggtcttttgcgttctctttccctctcccaacatg

SEQ ID NO: 119 - DNA, 40 bp, Homo sapiens
tattcttttgaagattcttcgttgtcaagccgccaaagtg

SEQ ID NO: 120 - DNA, 141 bp, Homo sapiens
cttcccctcagtgcggtcacatacttccagaagagcggaccagggctgctgccagcacctgccactcagagcgcctctgtcgctgggacccttcagaactctctttgctcacaagttaccaaaaaaaaaagagccaacatg

SEQ ID NO: 121 - DNA, 86 bp, Homo sapiens
cgctcttttccacgtgcgaaagccccggactcgtggagttgtgaacgccgcggactccggagccgcacaaaccagggctcgccatg

SEQ ID NO: 122 - DNA, 311 bp, Homo sapiens
ctgtcccttgctccaggcgctcactttgcgggcggcactttttccaggttgttaatccagctaatggagaaggatagatgcacgctacttggtttagaaaaaaaaacaaaaatgagcaaacgagacgccccttccgttttatgataactaagctgcagggaaataaatcggctggccctactgcaatctactgcactcgagaaacatcacagaaaattctttgatttatcttaatagtgacaagtgagcctgcttctgtcaattactgaagctataaggagattttttaaaaattaaacttcaacacaatg

SEQ ID NO: 123 - DNA, 212 bp, Homo sapiens
ccgcctctgttcaggacactgggtccccttggagcctccccaggcttaatgattgtccagaaggcggctataaagggagcctgggaggctgggtggaggagggagcagaaaaaacccaactcagcagatctgggaactgtgagagcggcaagcaggaactgtggtcagaggctgtgcgtcttggctggtagggcctgctcttttctaccatg

SEQ ID NO: 124 - DNA, 219 bp, Homo sapiens
agccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatg

SEQ ID NO: 125 - DNA, 30 bp, Homo sapiens
cacccttcttaaagcggcggcgggaagatg

SEQ ID NO: 126 - DNA, 190 bp, Homo sapiens
ggccctccctgcacggcctcccgtgcgcccctgtcagactgtggcggccggtcgcgcggtgcgctctccctccctgcccgcagcctggagaggcgcttcgtgctgcacacccccgcgttcctgccggcaccgcgcctgccctctgccgcgctccgccctgccgccgaccgcacgcccgccgcgggacatg

SEQ ID NO: 127 - DNA, 246 bp, Homo sapiens
ggccccctcctcgcgagttggtgccgctgccacctccgattccgagctttcggcacctctgccgggtggtaccgagccttcccggcgccccctcctctcctcccaccggcctgcccttccccgcgggactatcgcccccacgtttccctcagcccttttctctcccggccgagccgcggcggcagcagcagcagcagcagcagcaggaggaggagcccggtggcggcggtggccggggagcccatg

SEQ ID NO: 128 - DNA, 304 bp, Homo sapiens
gggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagagcagtgtgtggattacactatcactggaaaaatacgaattgagaagaaggaaaagactggaagatgcagaccttggttcctgttagtggaaacactgtaaggtcccagaaatggaaaagaaaatgaaataaatcagcagttatgaggcagagcctaagagaactatg

SEQ ID NO: 129 - DNA, 20 bp, Homo sapiens
gttcctctctccccaagatg

SEQ ID NO: 130 - DNA, 23 bp, Homo sapiens
actcccttttctttggcaagatg

SEQ ID NO: 131 - DNA, 515 bp, Homo sapiens
gtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatg

SEQ ID NO: 132 - DNA, 305 bp, Homo sapiens
ttttctttatcctgcagtctttacctcagcagaaccgcacaccacagactccctccagctctttgtgtgtggctctctcagggtccaacaagagcaagctgtgggtctgtgagtgtttatgtgtgcttttattcacttcacacttattgaaaagtgtgtatgtgagagggtggggtgtgtgtgtcaaagagagtgaggaagagaaggagagagagatcaattgattctgcagcctcagctccagcatccctcagttgggagcttccaaagccgggtgatcacttggggtgcatagctcggagatg

SEQ ID NO: 133 - DNA, 151 bp, Homo sapiens
ccgccccttacccggcgtgccccgcgcccggaggcgctgacgtggccgccgtcagagccgccatcttgtgggagcaaaaccaacgcctggctcggagcagcagcctctgaggtgtccctggccagtgtccttccacctgtccacaagcatg

SEQ ID NO: 134 - DNA, 569 bp, Homo sapiens
gcgccttttccggcagcggcggcggcagaactgggaggaggagttggaggccggagggagcccgcgctcggggcggcggctggaggcagcgcaccgagttcccgcgaggatccatgacctgacggggccccggagccgcgctgcctctcgggtgtcctgggtcggtggggagcccagtgctcgcaggccggcgggcgggccggagggctgcagtctccctcgcggtgagaggaaggcggaggagcgggaaccgcggcggcgctcgcgcggcgcctgcggggggaagggcagttccgggccgggccgcgcctcagcagggcggcggctcccagcgcagtctcagggcccgggtggcggcggcgactggagaaatcaagttgtgcggtcggtgatgcccgagtgagcggggggcctgggcctctgcccttaggaggcaactcccacgcaggccgcaaaggcgctctcgcggccgagaggcttcgtttcggtttcgcggcggcggcggcgttgttggctgaggggacccgggacacctgaatgcccccggccccggctcctccgacgcgatg

SEQ ID NO: 135 - DNA, 187 bp, Homo sapiens
cgccctcccgccgccgcccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatg

SEQ ID NO: 136 - DNA, 152 bp, Homo sapiens
cggcctcccgctctcacttccttctcgagcccggagccgctgccgccgcccccagctcccccgcctcggggagggcaccaggtcactgcagccagaggggtccagaagagagaggaggcactgcctccactacagcaactgcacccacgatg

SEQ ID NO: 137 - DNA, 46 bp, Homo sapiens
ctctcttcccactcgggtttgacctacagccgcccgggagaagatg

SEQ ID NO: 138 - DNA, 194 bp, Homo sapiens
ccacctctgtctgctgccggcagaaagccacaagccatgaaaactgattgagatgagaagaattcatctgggactggcttttgctttaggatggtgttggaagttgctcgttgtcgctaggagcctgctccactgtaagggtgtcaggatctgaagagctatggtgaaacaccactgaagcattgccaaggatg

SEQ ID NO: 139 - DNA, 323 bp, Homo sapiens
gcatctcttcgcctctcggagctggaaatgcagctattgagatcttcgaatgctgcggagctggaggcggaggcagctggggaggtccgagcgatgtgaccaggccgccatcgctcgtctcttcctctctcctgccgcctcctgtctcgaaaataacttttttagtctaaagaaagaaagacaaaagtagtcgtccgcccctcacgccctctcttcctctcagccttccgcccggtgaggaagcccggggtggctgctccgccgtcggggccgcgccgccgagccccagccgccccgggccgcccccgcacgccgcccccatg

SEQ ID NO: 140 - DNA, 80 bp, Homo sapiens
cggcctctagtcatcgccctcgcagcggcggccaacatcaccgccactgccacccctcccagactgtggacgggaggatg

SEQ ID NO: 141 - DNA, 131 bp, Homo sapiens
aggcctcttggttctgcggcacgtgacggtcgggccgcctccgcctctctctttactgcggcgcggggcaaggtgtgcgggcgggaaggggcacgggcacccccgcggtccccgggaggctagagatcatg

SEQ ID NO: 142 - DNA, 42 bp, Homo sapiens
cgacctttctctgcgcagtacggccgccgggaccgcagcatg

SEQ ID NO: 143 - DNA, 108 bp, Homo sapiens
gcgcctttttttccccccatacaatacaagatcttccttcctcagttcccttaaagcacagcccagggaaacctcctcacagttttcatccagccacgggccagcatg

SEQ ID NO: 144 - DNA, 220 bp, Homo sapiens
cgacctctttgcagctcgcacagctaagggcgagggcgcccttcggcagaagcagcaaaccgccggcaagcccagcgaggagggctgccggggtctgggcttgggaattggctggcacccagcggaaagggacgtgagctgagcggcgggggagaagagtgcgcaggtcagagggcggcgcgcagcggcgctccgcgaggtccccacgccgggcgatatg

SEQ ID NO: 145 - DNA, 84 bp, Homo sapiens
tctccttttgctctcagatgctgccagggtccctgaagagggaagacacgcggaaacaggcttgcacccagacacgacaccatg

SEQ ID NO: 146 - DNA, 142 bp, Homo sapiens
cttcctcttttggggttcttcctttctctctcagctctccgtctctctttctctctcagcctctttctttctccctgtctcccccactgtcagcacctcttctgtgtggtgagtggaccgcttaccccactaggtgaagatg

SEQ ID NO: 147 - DNA, 70 bp, Homo sapiens
gcctctctcttgctgcctagcctcctgccggcctcatcttcgcccagccaaccccgcctggagccctatg

SEQ ID NO: 148 - DNA, 66 bp, Homo sapiens
cggcctttttctagccaggctctcaactgtctcctgcgttgctgggaagttctggaaggaagcatg

SEQ ID NO: 149 - DNA, 37 bp, Homo sapiens
cttcctttccgcacaggggccgccgagcggggccatg

SEQ ID NO: 150 - DNA, 502 bp, Homo sapiens
ttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatg

SEQ ID NO: 151 - DNA, 502 bp, Homo sapiens; identical to SEQ ID NO: 150

SEQ ID NO: 152 - DNA, 153 bp, Homo sapiens
ctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatg

SEQ ID NO: 153 - DNA, 122 bp, Homo sapiens
ctttcttttcagtccttgcgcaccggggaacaaggtcgtgaaaaaaaaggtcttggtgaggtgccgccatttcatctgtcctcattctctgcgcctttcgcagagcttccagcagcggtatg

SEQ ID NO: 154 - DNA, 235 bp, Homo sapiens
cagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagtattcttgccatgagaaaaagaatgtgataagttattcaacttatg

SEQ ID NO: 155 - DNA, 488 bp, Homo sapiens
agatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatg

SEQ ID NO: 156 - DNA, 217 bp, Homo sapiens
aagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatg

SEQ ID NO: 157 - DNA, 93 bp, Homo sapiens
ccgcctcctcccccgacttccttccctgagcacggcggcggcggggacgagcaccggcctgcgcgcggagccggcaccggatgacccaacatg

SEQ ID NO: 158 - DNA, 73 bp, Homo sapiens
ctgtcttttcgcttgtgtccctctttctagtgtcgcgctcgagtcccgacgggccgctccaagcctcgacatg

SEQ ID NO: 159 - DNA, 91 bp, Homo sapiens
ctgtctcccctcgccgcatccactctccggccggccgcctgcccgccgcctcctccgtgcgcccgccagcctcgcccgcgccgtcaccatg

SEQ ID NO: 160 - DNA, 118 bp, Homo sapiens
cgttccctacttcctgtgctcttgcggagacgcgcgcgtcggggtttaacgcgtttctgggccgccgtaagcccggcctaggggcagctttgactcgagagccggctataggcgcatg

SEQ ID NO: 161 - DNA, 313 bp, Homo sapiens
caccctttcggatgcctcccctagaaccctaccactttccacccctttccgtctgttatttctcccaaacttgcgcccgcacaggcccctctggaacactcctgccccgtagtgcccctcgtccccgctccgtagagaaagagcgtgcgtgccgcgcatttctggcctggggagcgggtggagtaaacctgcgggaaccattttacgacaacgtgcggctgtgcggtgtggctgacggcaacgccgctgctcttggagaggtcactccggagacggcgttggttttggggtgtggggggttggtggcactatg

SEQ ID NO: 162 - DNA, 711 bp, Homo sapiens
ccttccctggcatctggagggaccaccgttgccgcgtcttcggcttccacgatctgcgttcgggctacgcggccacggcggcagccactgcgactcccactgtgcctggctctgtccatattagttcccaggcggccgtcgccgttccagcagcggcagcggcagcggcagcggcggacatgttgtgaggcggcggcgcgggtgtctgaaggatggtttggccgaggcggcggcaacggctgctggcggcggcggcagcggcagcggggcctcgggctctatagagccgagcccgctgggtacccgcccggtaccgcggcgaggccagtgcccctggatcttgcctctgctccgacgccgttggggaccagttaggcgacagcgcccgcccctctgaggagacacgaaggtggttccccagccgctcaaatttccggaccaccgcgctttcccctcctcagcctgggctgtgctctctctagaatcctcgggcccccactttcttcccaaactcatcctaaatctctcacacacgcgagtgttcccagccctcaagccagctgctcctccgttcattttctgcaccctcttcgcaaagcaccccccgggatcactctccgagggcgactttttgagaaatctcggtggagtagtggaccagagctggggagtttttaaaagccggggcgcgagaaacaggaaggtactatg

SEQ ID NO: 163 - DNA, 388 bp, Homo sapiens
ttttctttttcgtgcgagccctcgcgcgcgcgtacagtcatcccgctggtctgacgattgtggagaggcggtggagaggcttcatccatcccacccggtcgtcgccggggattggggtcccagcgagacctccccgggagaagcagtgcccaggaggttttctgaagccggggaagctgtgcagccgaagccgccgccgcgccggagcccgggacaccggccaccctccgcgccacccaccctcgccggctccggcttcctctggcccaggcgccgcgcggacccggcagctgtctgcgcacgccgagctccacggtgaaaaaaaagtgaaggtgtaaaagcagcacaagtgcaataagagatatttcctcaaatttgcctcaagatg

SEQ ID NO: 164 - DNA, 104 bp, Homo sapiens
cagtccctctggctgagacctcggctccggaatcactgcagcccccctcgccctgagccagagcaccccgggtcccgccagcccctcacactcccagcaaaatg

SEQ ID NO: 165 - DNA, 90 bp, Homo sapiens
cgttctcttccgccgtcgtcgccgccatcctcggcgcgactcgcttctttcggttctacctgggagaatccaccgccatccgccaccatg

SEQ ID NO: 166 - DNA, 41 bp, Homo sapiens
ctgtcttttcagtcgggcgctgagtggtttttcggatcatg

SEQ ID NO: 167 - DNA, 37 bp, Homo sapiens
gtttcttttctttgaatgacagaactacagcataatg

SEQ ID NO: 168 - DNA, 142 bp, Homo sapiens
gcgcctcctccgcccgccgcccgggagccgcagccgccgccgccactgccactcccgctctctcagcgccgccgtcgccaccgccaccgccaccgccactaccaccgtctgagtctgcagtcccgagatcccagccatcatg

SEQ ID NO: 169 - DNA, 105 bp, Homo sapiens
ccgccttttacttcggcccgcttcttctggtcactccgccaccgtagaatcgcctaccatttggtgcaagcaaaaagcaatcagcaattggacaggaaaagaatg

SEQ ID NO: 170 - DNA, 60 bp, Homo sapiens
cttcctctttctcgactccatcttcgcggtagctgggaccgccgttcagtcgccaatatg

SEQ ID NO: 171 - DNA, 194 bp, Homo sapiens
ctgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatg

SEQ ID NO: 172 - DNA, 183 bp, Homo sapiens
gccccttttcacaatatttgattaggaatttggggcgggaccctggtctggcacaggcacgcacactctcagtagactctttcactcctctctctcttcctctctcacacgttctccaacccaaggaggccagacagagggacgtggtcactctctgaaaagttcaacttgagagacaaaatg

SEQ ID NO: 173 - DNA, 206 bp, Homo sapiens
cgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatg

SEQ ID NO: 174 - DNA, 80 bp, Homo sapiens
cgctctctgctcctcctgttcgacagtcagccgcatcttcttttgcgtcgccagccgagccacatcgctcagacaccatg

SEQ ID NO: 175 - DNA, 36 bp, Homo sapiens
caccctctctggacagcccagggccgcaggctcatg

SEQ ID NO: 176 - DNA, 99 bp, Homo sapiens
ctgtccttaccttcagcaggagccggttccctgtgtgtgtgtccgctcgccctctgctccgtcctgcggctgcccactgccctcctacggtccaccatg

SEQ ID NO: 177 - DNA, 176 bp, Homo sapiens
gcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatg

SEQ ID NO: 178 - DNA, 190 bp, Homo sapiens
cggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatg

SEQ ID NO: 179 - DNA, 23 bp, Homo sapiens
cattctccccagaggccgagatg

SEQ ID NO: 180 - DNA, 71 bp, Homo sapiens
gctccctttagcgagtccttcttttcctgactgcagctcttttcattttgccatccttttccagctccatg

SEQ ID NO: 181 - DNA, 65 bp, Homo sapiens
ctgtcctttcgtggctcactccctttcctctgctgccgctcggtcacgcttgctctttcaccatg

SEQ ID NO: 182 - DNA, 62 bp, Homo sapiens
ccgccttccctgcgcagtcggtgtctccgcgtcgctgggtgggacttggctcggcggccatg

SEQ ID NO: 183 - DNA, 109 bp, Homo sapiens
ctcccttcttgactctctgttcacagaactcaggctgcctccagccagcctttgcccgctagactcactggccctgagcacttgaaggtgcagcaagtcactgagaatg

SEQ ID NO: 184 - DNA, 68 bp, Homo sapiens
ctgtccctcactcgccgccgacgacctgtctcgccgagcgcacgccttgccgccgccccgcagaaatg

SEQ ID NO: 185 - DNA, 61 bp, Homo sapiens
ccgccttttcccctgcctgcccttcgggcacctcaggaaggcaccttcctctgtcagaatg

SEQ ID NO: 186 - DNA, 217 bp, Homo sapiens
cgtcctctggccgcgcctgcggccgcacgcccagcgcccctcgcctaacctcgcgcccgggccgcgcctcctcctcctcctgctccccgccgcttccgtttctcgagggaaaggctgctgcctcctgctctgtcctcatccccggcttagctgacggcccagagggtgggtgccaattccaccagcagctgcaactgaaaagcaaggttcagaaatg

SEQ ID NO: 187 - DNA, 186 bp, Homo sapiens
gtttcctctccttgttttgctttcgatctggactgttctcaggcaagccggggagtaacttttagttttgctcctgcgattattcaactgacgggctttcatttccatttcacataccctagcaacacttataccttgcggaattgtattggtagcgtgaaaaaagcacactgagagggcaccatg

SEQ ID NO: 188 - DNA, 136 bp, Homo sapiens
ttttcttcttttttcttctttcttaaagcgaactgtactcctctgctgttcctttgaacttggttcagtaggaagaagtgatatcctccccagaccatctgctttggggagcttggcaaaactgtccagcaaaatg

SEQ ID NO: 189 - DNA, 351 bp, Homo sapiens
ccgccttcctccctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatg

SEQ ID NO: 190 - DNA, 92 bp, Homo sapiens
ctctccccctcctccccctcccgctccaagattcgccgccgccgccgccgcagccgcaggagtagccgccgccggagccgcgcgcagccatg

SEQ ID NO: 191 - DNA, 64 bp, Homo sapiens
gctcctcccgcgaatcgcagcttctgagaccagggttgctccgtccgtgctccgcctcgccatg

SEQ ID NO: 192 - DNA, 145 bp, Homo sapiens
attcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatg

SEQ ID NO: 193 - DNA, 85 bp, Homo sapiens
ctgtcttttccgtgctacctgcagaggggtccatacggcgttgttctggattcccgtcgtaacttaaagggaaattttcacaatg

SEQ ID NO: 194 - DNA, 175 bp, Homo sapiens
ttttctttcctggctgatgatttgtcattctagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatg

SEQ ID NO: 195 - DNA, 72 bp, Homo sapiens
ccatctctctcgggtggagtcttctgacagctggtgcgcctgcccgggaacatcctcctggactcaatcatg

SEQ ID NO: 196 - DNA, 128 bp, Homo sapiens
ttctctcttttttgcacatctggctgaactgggagtcaggtggttgacttgtgcctggctgcagtagcagcggcatctcccttgcacagttctcctcctcggcctgcccaagagtccaccaggccatg

SEQ ID NO: 197 - DNA, 498 bp, Homo sapiens
tgttcctttcccctccgcttctctgacctagctgcgcggccccggcccgggagctgccgaacccgcgcctcccctgggtgaggaggacacgcctgccctcgtcgagaaaacttttcctgccgactcagttggggcggcggtggcaggaagtgcgggcagcgacctctcctccgcctgccccgcgcgccctgccggaggtcggcgctgagcttgcgatcaagtttgtgggggccccccttcccagttgccggcgagtctcgcctcgagaggggcgcccgaccccggggagggcggcaggccagggcgaaggccaagggcgtgtggtggcgccggagactaggtgcggagcaaggcggggactcgcacccgcatccgagagcgcggaggtcgcgcagcccgggagaagggagcctccggcggctgcttcctagagtccacagtgcgctgtctcctttggctgaggagagtgtcctggccccgagtctatcgaggaaaatg

SEQ ID NO: 198 - DNA, 127 bp, Homo sapiens
ccgcctcttttcccgagatgccccggggagggaggacaacaccttcaaagacaggccctctgagtccgacgagctccagaccatccaagaagacagtgcagccacctccgagagcctggatgtgatg

SEQ ID NO: 199 - DNA, 401 bp, Homo sapiens
cattcttcccaggacctcagcgcagccctggcccaggaaggcaggagacagaggccaggacggtccagaggtgtcgaaatgtcctggggacctgagcagcagccaccagggaagaggcagggagggagctgaggaccaggcttggttgtgagaatccctgagcccaggcggtagatgccaggaggtgtctggactggctgggccatgcctgggctgacctgtccagccagggagagggtgtgagggcagatctgggggtgcccagatggaaggaggcaggcatgggggacacccaaggccccctggcagcaccatgaactaagcaggacacctggaggggaagaactgtggggacctggaggcctccaacgactccttcctgcttcctggacaggactatg

SEQ ID NO: 200 - DNA, 131 bp, Homo sapiens
gggcctttcccagtgcggccgccgccgccacagctgcagtcagcaccgtcaccccagcagcatccgccgcctgcaccgcgcgtgcggcccgccccggcctgaccccgccgccgaacccggcgccagccatg

SEQ ID NO: 201 - DNA, 396 bp, Homo sapiens
agctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatg

SEQ ID NO: 202 - DNA, 1338 bp, Homo sapiens
agcccttcttggggaagtcagctacccagcagcctgtagtcctcggctacccaccctcaccgcctggggtcccatggtgagacagctgggtgggcatcaggcttctgcagagggccaggccggagggagctgggcgagggagtggggctggctcctggcttgcaccggcctcgtggaatccaggcctcagacctgatcgctggcgaaactggctctgtgcgctggagcccctggtcttctgcgtctgtcctcctcccggccagactttactcctggctcagcgacaggtatttgctatggaagagctgtccctccctcccctcggtgggcctgggtccacctccacctcctcttcaggtccgcaccttcctcccctttaaaacaccagccgggcgcagacccgttctaggcttttccatggtgcttccgccaaagcttgtgaccgagtccttcccgcctagggctggtgggcctcccctgctggtaggtctctcttcgctttctttactcagaactgaagctctcattccccacccaccaaggaaaaacaaaagggaagaagccacagctggccccggcttgctttggcacaggtgtttccccccggccccccgtcgggcaccctggttcctgttctgtccctgccccacgcgaccctggggctcccacccgggctcctcagcctcccctgggttggggtggggggactggctcccagcccttggcctagggtttggtgaacgcctttcctggactgcgggcccacttcaggcgcggctccaggctgggcagctgcgctggagggccgagggcaggggtggggtcgggcgtccaccctcagggttgcgccagggagccggaaagccgactcccgaagttggggtcctgggaaaacttgggtcctgggttgactgagaagcggcggggaaaggaggcgggccaggaggagggggcctggcggacgccggccggggggcggggcgcggcggggctgtcggtcacgcccctcagtccgccccgccccgccccgcctgccggggaagggccacgttgcccgcccggccgtccggccccggcgcgccgcagaaagggctggcgagtcgaaaggcgaggcggccgcggcagcgcttgggacgcgcctgggcaccgggctcgctccctgcgccccggagcaggccaagttcggggccaggacgtcgggaggacctggtgcatggctgcctcctaatcccatagtccagaggaggcatccctaggactgcgggcaagggagccgggcaagcccagggcagccttgaaccgtcccctggcctgccctccccggtgggggccaggatg

SEQ ID NO: 203 - DNA, 522 bp, Homo sapiens
ctgcctcccgcccccggggccaaagtacaaagggaggaggaagaagggagcggggtcggagccgtcggggccaaaggagacggggccaggaacaggcagtctcggcccaactgcggacgctccctccaccccctgcgcaaaaagacccaaccggagttgaggcgctgcccctgaaggccccaccttacacttggcgggggccggagccaggctcccaggactgctccagaaccgagggaagctcgggtccctccaagctagccatggtgaggcgccggaggccccggggccccacccccccggcctgaccacactgccctgggtgccctcctccagaagcccgagatgcggggggccgggagacaacactcctggctccccagagaggcgtgggtctggggctgagggccagggcccggatgcccaggttccgggactagggccttggcagccagcgggggtggggaccacgggcacccagagaaggtcctccacacatcccagcgccggctcccggccatg

SEQ ID NO: 204 - DNA, 90 bp, Homo sapiens
ccgccttctccgcagccccgcaggccccgggccctgtcattcccagcgctgccctgtcttgcgttccagtgttccagcttctgcgagatg

SEQ ID NO: 205 - DNA, 562 bp, Homo sapiens
ggccctttataatgcgagggtctggacggctgaggacccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctg

SEQ ID NO: 206 - DNA, 38 bp, Homo sapiens
tggcctctcggttccgcggcgcaccggagggcagcatg

SEQ ID NO: 207 - DNA, 88 bp, Homo sapiens
cttcctctccaggaatccgcggagggagcgcaggctcgaagagctcctggacgcagaggccctgcccttgccagacggcgcagacatg

SEQ ID NO: 208 - DNA, 29 bp, Homo sapiens
ccttcttcctcctgcccgtagtagccatg

SEQ ID NO: 209 - DNA, 37 bp, Homo sapiens
ccgtcctttcatcctggcgtttgcctgcagcaagatg

SEQ ID NO: 210 - DNA, 159 bp, Homo sapiens
tgccccttccccggccaagcccaactccggatctcgctctccaccggatctcacccgccacacccggacaggcggctggaggaggcgggcgtctaaaattctgggaagcagaacctggccggagccactagacagagccgggcctagcccagagacatg

SEQ ID NO: 211 - DNA, 101 bp, Homo sapiens
gcccctcctccgccgccggctcccgggtgtggtggtcgcaccagctctctgctctcccagcgcagcgccgccgcccggcccctccagcttcccggaccatg

SEQ ID NO: 212 - DNA, 108 bp, Homo sapiens
gcgtcctttccctggtgtgattccgtcctgcgcggttgttctctggagcagcgttcttttatctccgtccgccttctctcctacctaagtgcgtgccgccacccgatg

SEQ ID NO: 213 - DNA, 456 bp, Homo sapiens
cattccttttgtagaaaaacccgtgcctcgaatgaggcgagactcagagaggacccaggcgcggggcggacccctccaattccttcctcgcgcccccgaaagagcggcgcaccagcagccgaactgccggcgcccaggctccctggtccggccgggatgcggccggtacccgctccccgccgggaacaacctctccactcttcctgcagggagctggtgccagccgacagccgcgccagggccgctccgggtaccagggtcggatcgggtgacgtcgcgaacttgcgcctggccgccaagccggcctccaggctgaagaaggacccgccccggccttgacccgggccccgcccctccagccggggcaccgagccccggccctagctgctcgcccctactcgccggcactcgcccggctcgcccgctttcgcacccagttcacgcgccacagctatg

SEQ ID NO: 214 - DNA, 104 bp, Homo sapiens
gcgtcttcccgagccagtgtgctgagctctccgcgtcgcctctgtcgcccgcgcctggcctaccgcggcactcccggctgcacgctctgcttggcctcgccatg

SEQ ID NO: 215 - DNA, 512 bp, Homo sapiens
gcttccccttctccccggcggttagtgctgagagtgcggagtgtgtgctccgggctcggaacacacatttattattaaaaaatccaaaaaaaatctaaaaaaatcttttaaaaaaccccaaaaaaatttacaaaaaatccgcgtctcccccgccggagacttttattttttttcttcctcttttataaaataacccggtgaagcagccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgttgagtagttttcaattccggttgatttttgtccctctgcgcttgctccccgctcccctccccccggctccggcccccagccccggcactcgctctcctcctctcacggaaaggtcgcggcctgtggccctgcgggcagccgtgccgagatg

SEQ ID NO: 216 - DNA, 270 bp, Homo sapiens
cgctctttctctccggtacacacagctccccacattcgcacccctgcccgcgcgccgggccgcctgactgcacggcttcccctccagccagatgctggagaacacacactgattcgctgctttccaagaccctgttcagtctctttctctatacaaagatttttttaaaaactatatataagaattctttatttgcaccctccctccgagtcccctgctccgccagcctgcgcgcctcctagcaccacttttcactcccaaagaaggatg

SEQ ID NO: 217 - DNA, 65 bp, Homo sapiens
gggtctttccctcactcgtcctccgcgcgtcgccgctcttcggttctgctctgtccgccgccatg

SEQ ID NO: 218 - DNA, 222 bp, Homo sapiens
cgctcccctttcccctcccgccggacctgccaggaggtgggctggcgcggagggagggccctgtcccctgtccctttaaggaggagggccaaacgccggcctagagtgcggcgtagcccccacccgccgtgccctcaccccagagcagctgcagcctcagccggccgcccctccgccagccaagtccgccgctctgacccccggcagcaagtcgccaccatg

SEQ ID NO: 219 - DNA, 300 bp, Homo sapiens
cggcctctgtgagccgcaacctttccaagggagtggttgtgtgatcgccatcttagggagtgagtgtggccgggccttctcctgtggcgggtgtggggagcggagcccagagctcctgtggggccgctgctttggcggtgggcccagccgggagcagcctctttcgaaggccgccgtgacctcttcaagggcgtggagacgggaaggaaaaggccccggttggggttccagggcgccggtaacgttaaccggcgccttgcctgtcctctaaccgtcgctccctcctcccctagaaagatg

SEQ ID NO: 220 - DNA, 437 bp, Homo sapiens
cctcccctttactcctggctgcggggcgagccgggcgtctgctgcagcggccgcggtggctgaggaggcccgagaggagtcggtggcagcggcggcggcgggaccggcagcagcagcagcagcagcagcagcagcaaccactagcctcctgccccgcggcgctgccgcacgagccccacgagccgctcaccccgccgttctcagcgctgcccgaccccgctggcgcgccctcccgccgccagtcccggcagcgccctcagttgtcctccgactcgccctcggccttccgcgccagccgcagccacagccgcaacgccacccgcagccacagccacagccacagccccaggcatagccttcggcacagccccggctccggctcctgcggcagctcctctgggcaccgtccctgcgccgacatcctggaggttgggatg

SEQ ID NO: 221 - DNA, 279 bp, Homo sapiens
ggatctcttcgtctttgcagcgtagcccgagtcggtcagcgccggaggtgagcggtgcaggaggctacgccatcagtccccaccaagggccagtcgcccggctagtgcggaatcccggcgcgccggccggccccgggcacgcaggcagggcggcgcaggatccagggcgtctgggatgcagtggagctcagagagaggagaacggctcctcacgcctggggcctgctcttcagaagtccccagcgccgttccttccagatcaggacctcagcagccatg

SEQ ID NO: 222 - DNA, 571 bp, Homo sapiens
cggcctcctcggcgcagccatcctcttggctgccgcgggcggcaaagcccacggcatctgccatttgtcattcagcccgtcggtaccgccccgagccttgatttagacacggctggggcgtgctctggcctcactctccgggcgggtgctggacggacggacggacggggcagccgtgctcacagctcagcagcgcggggccttggcgcgcggggcgcttccccgggtcgccgtcatggccgcggaggtggcacgcccgagcggcctcgcctgagctccgggggtcgtcgccccgcagggattgctgtcacgtctaatgtggctgctgcctcgtgtcacatctgaaactcatctgtacctcacttagaaagtggttctgattagacaagacttttcgttgcagtcgacagaaacctaatgggaccattgaagaattccaaacaggtatttgcataggaatcagaggagttaatcttgtctcttctcacaggtttgaatcttcagacaaacttctgggaggactcggtccctgcctcgcagcagatgttccctgtcactcagtaggcatatg

SEQ ID NO: 223 - DNA, 53 bp, Homo sapiens
tgctctcttggctccggaacccccgcgggcgctggctccgtctgccagggatg

SEQ ID NO: 224 - DNA, 110 bp, Homo sapiens
cccccttcccggccagacggcgggcaagacagctgggtgtacagcgtcctcgaaaccacgagcaagtgagcagatcctccgaggcaccagggactccagcccatgccatg

SEQ ID NO: 225 - DNA, 81 bp, Homo sapiens
cagtcctttcgcgcctcggcggcgcggcatagcccggctcggcctgtaaagcagtctcaagcctgccgcagggagaagatg

SEQ ID NO: 226 - DNA, 31 bp, Homo sapiens
ggtccttccacgtgctttcggcggcgacatg

SEQ ID NO: 227 - DNA, 191 bp, Homo sapiens
tgttcttctcgtggttccagtggggagagaaggaggaagtagggagcggggtggcaggggggggacccgccgcggctgctgccaccgccgccaccaccgcctctgctcgtggcgtgggaaaggaggtgtgagtcccgggcgcgagccggcggcggcgccgctgcgggagggtcggcggtgggaaggcgatg

SEQ ID NO: 228 - DNA, 61 bp, Homo sapiens
cggtcttccagtttcccggcgtgcttagggcgcgccaaatgggagggggagacgcaagatg

SEQ ID NO: 229 - DNA, 75 bp, Homo sapiens
cggcctccgccgctgccgccgccgctgctacagccgccgccgccgctgttgccgcggcttgttattcttaaaatg

SEQ ID NO: 230 - DNA, 156 bp, Homo sapiens
ctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatg

SEQ ID NO: 231 - DNA, 800 bp, Homo sapiens
cgccccctcttcctcgccctctctcgcgggtcggggttacatggcggcgactgcggcaaagcgagagcctcggagacgccgctgccgccagcacagccggagacctgagccgacactgggggcagtccgcgagccccgcactctctcgatgagtcggagaagtcccgttgtatcagagtaagatggacggtagctttgattgtgattgtggtgagctggagccacctgatcactaacaaaagacatcttctgttaaccaacagccgccagggcttcctgttgaaataaatatatagcaacaaaggaaaaaaagaagcaaaacggaaatagtgcttaccagcaccttagaatgatgctgctcaggaccagtccaacactgaatgtatctgcactgtgaggagaatgttcatagaagcctgttgtgtgcatatttattcacatttttgttaaatgttaaatcgtttagcacggtaatctgagtgcacagtatgtcatttcattccgtttgagtttcttgttttcgttaaatgtctgcagagttgctgcccctttcttgaactatgagtactgcaatctttttaattctcaatatgaatagagctttttgagctttaaatctaaggggaactcgacaggcctgtttggcatatgcaatgaacatcaagaaaccatcttgctgtggaagcataattatttttcttctccctttttgaaagatctttccttttgatgccagttttcttccttgtttacacaagttcaatttgaaaggaaaaggcaatagtaagggtttcaaaatg

SEQ ID NO: 232 - DNA, 131 bp, Homo sapiens
cctccccttccctacatctagccgccgcgctttcccgctcccgcagcagcagcctcccgcgtcgctgtcgctgttgcctccgccacctcctccgccgccgcgcgcccctcggagttccgcgccccaccatg

SEQ ID NO: 233 - DNA, 218 bp, Homo sapiens
ttgcctctggctctgaggcggcggcgccgggcgctgcgaaggctcggccgctgtagtcagtggtgtggggtgcgcaagggcacggacctcggagctctccccgcttgcgccgagtttctcagcgccttccccacccaaaccggggtctcgcagtcggaagcactcagagtgcagccccgcgcggggccggtcgtaaccgcgccgcgggccggacgatg

SEQ ID NO: 234 - DNA, 26 bp, Homo sapiens
agttctttctgcccacactagacatg

SEQ ID NO: 235 - DNA, 35 bp, Homo sapiens
tgttcttctgtgccgggggtcttcctgctgtcatg

SEQ ID NO: 236 - DNA, 76 bp, Homo sapiens
cagcccctctggcaggctcccgccagcgtcgctgcggctccggcccgggagcgagcgcccggagctcggaaagatg

SEQ ID NO: 237 - DNA, 158 bp, Homo sapiens
ctccctttgcaggacgtcacggaggactgcaggggcctgagccgctgctgccgccgccgccgcgcagccccacatcaacgcaccggggtcctgtcaccgccaccgccaaaaaagtcaccgccgctagggtcgccgttgcatcggtgcagggcaagatg

SEQ ID NO: 238 - DNA, 48 bp, Homo sapiens
ctctctctctctctctctcgctcgttccctaacattaaagagaaaatg

SEQ ID NO: 239 - DNA, 174 bp, Homo sapiens
gcgcccctctgctccggctcggggcgggcactggcggagggactggccagtcccctcctccgcgccggccccaaccctgtcgctgccgccgcgctccgagtccccattcccgagctgccgctgttgtcgctcgctcagcgtctccctctcggccgccctctcctcgggacgatg

SEQ ID NO: 240 - DNA, 246 bp, Homo sapiens
ccgccttttcccgcggaggcgccgagcggccatattgcggagctgtctgcggtggcggcggcgcctctcgtctcccgcggcccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatg

SEQ ID NO: 241 - DNA, 120 bp, Homo sapiens
tcgccttcttgcacttcgcgggagaagttgttggcgcgaatggatcctgagcctcgataacagattcctcaaccggcccacccgccagccagccagcgccttcatcctggggctgcgatg

SEQ ID NO: 242 - DNA, 284 bp, Homo sapiens
gcatctttctcgaggagctctcctgggcggctgaagaaggagcttcttctccggagtgcgccggcggtggcgcctgcggacctaactagctccaggttaggccgagctttgcgggaaagcagcggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatg

SEQ ID NO: 243 - DNA, 17 bp, Homo sapiens
tgctcttcccggtcatg

SEQ ID NO: 244 - DNA, 49 bp, Homo sapiens
cgttcttccttttcgatccgccatctgcggtggagccgccaccaaaatg

SEQ ID NO: 245 - DNA, 311 bp, Homo sapiens
cttcctttagcgtgaaccgcgggtgcggtgcctcccgtgaaaataataaattcaccgtcacgcttgttgtgaacgcgggtggttcccgaaacttggaggcttcccgtaaacccagctccttcctcatctgggaggtgggtcccgcgcgggtccgccgcctcctccctggcccctccctctcgtgtctttcattttcctggggctccggggcgcggagaagctgcatcccagaggagcgcgtccaggagcggacccgggagtgtttcaagagccagtgacaaggaccaggggcccaagtcccaccagccatg

SEQ ID NO: 246 - DNA, 125 bp, Homo sapiens
ctttcttttgcgcaggcgtcgcgccctggggccggggccgggcggcaccgcggtgcgcaagcgcaaccgtcggtgggtcggggatcggtcgcctgagaggtatcacctcttctgggctcaagatg

SEQ ID NO: 247 - DNA, 134 bp, Homo sapiens
agttctccttccaccttcccccacccttctctgccaaccgctgtttcagcccctagctggattccagccattgctgcagctgctccacagcccttttcaggacccaaacaaccgcagccgctgttcccaggatg

SEQ ID NO: 248 - DNA, 339 bp, Homo sapiens
cgccctcctacttccccgtctgcgtccgcgttcgcggctcccgtttgcatcatccccgtctgcgtccgcgttcgcggctcccgtttgcatcatctccagccggcggctgctccagggaggctgggcgcgatcctctccgcccgcggctccaacccgcactctgcgcctctcctcgcctttctcgcacctgctcctgcgccaggcccggagacccccggggcggcttcccagaacctgcggagcacaactggccgaccgacccattcattgggaaccccgtcttttgccagagcccacgtcccctgccacctctagctcggagcggcgtgtagcgccatg

SEQ ID NO: 249 - DNA, 22 bp, Homo sapiens
ctgcctctttctgagcggcatg

SEQ ID NO: 250 - DNA, 53 bp, Homo sapiens
ctatctctcgataaagttgttgttgcggcttccgccgcgggtggaagaagatg

SEQ ID NO: 251 - DNA, 560 bp, Homo sapiens
ctatctctcatctttccgctcttagctgggagtgctccgcctagtcacttttcttaaggtggctcgtcgaggcctgacttcttccccgaaatcacgtccctagacagcctcctattttaccactaactttactcctgcagttattcagcggtaggaaactgaaaccaaaaaccagtgtaagcaagtaaacatctaaactgtttcaggagccgcgtagaaggaacgcggcggtgtgccccggaagcggaagtagattctcctatagaaaggctggactacgcggagtggtgacgtttcctcattgggcggaaggttcgctggcactccgttggtcttccagctggtgggagttgacgacgtggtgctgggcgttgggaccctactttatctagttcgggaagttgggttgtggggtcatacctgtctgtctgctcccagctttcttgggtttcttccgacggcgtggggcctcgctaaggaattcccggcccctcagggccacggctttagcggtgtcttttgcgagttcttcgtaagtacatcttaaagctgtcaagatg

SEQ ID NO: 252 - DNA, 71 bp, Homo sapiens
cggtctttcggatgctgacgctctcttcctgtctttgtggctccggaaaggcgtttgggatgccaacgatg

SEQ ID NO: 253 - DNA, 161 bp, Homo sapiens
ttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatg

SEQ ID NO: 254 - DNA, 23 bp, Homo sapiens
tgttcttcccatcggcgaagatg

SEQ ID NO: 255 - DNA, 199 bp, Homo sapiens
ggtccttcccctaaaacttggcactgccgatactcccagcccgttccttcccaagtcaggaacttgcaggggaccccttggcaattctttttctctcaagagcagacagccttcagtcccagccgctgccagggctggtgtgtctgacccagctgtggtttttccaggcctgaaggccccggagtgcaccagcggcatg

SEQ ID NO: 256 - DNA, 897 bp, Homo sapiens
cagtctcctccccgaggtgccggtggccccgccgccactccctccggctccctccctcccgccgcggcgcgcatctcattccagccctcattccgcgcattccagcgtcctcctcgcacactcgaggccagggggcgggagggccgcagctccggcgccgccgcgtcccgccaggtgagaggcgcccgcgcccgccgcacccgccggcgccctcacgggccgcgcgccccacgccgccgcagccgaccgctcgcgccgcgtgctcggctgctcttttctttccgccgcccgcgttcccgccttggacctctgcgctccgacgcgctccgtcccgacctctggcttccctccgcgctccggcgctgctcgctgcccctctcccgcttccctcctgtccgccccgcgctcccctcctcgctcccggttgactcactcctccaggaatagggatccccgtgttttcccgtcagtcccattctgggaaaactcctccctccgcgcgctccgctccgctccgctgggcgcaccggggccggtcggcgcggggtgggcttggccccgcggccccgccttcactgcgccgcccgtcggccccggccggagcccggctctgcgcgctgacgccctgtcgtccccgcagaacgatcgccgcggccggaagagttggcgctcggggcggactccttggaactggcttagcgcacccatcccaccttcccgcaccctgggaccggtcggaacgagctgattgcccgctacatcaagctccggacagggaagacccgcaccaggaagcaggtctccagccacatccaggtgctggctcgtcgcaaagctcgcgagatccaggccaagctaaaggaccaggcagctaaggacaaggccctgcagagcatg

SEQ ID NO: 257 - DNA, 86 bp, Homo sapiens
ttttctttcctccagtctcggggctgcaggctgagcgcgatgcgcggagacccccgcgggggcggcggcggccgtgagccccgatg

SEQ ID NO: 258 - DNA, 121 bp, Homo sapiens
cggccttttccgcccgctcccccctccccccgagcgccgctccggctgcaccgcgctcgctccgagtttcaggctcgtgctaagctagcgccgtcgtcgtctcccttcagtcgccatcatg

SEQ ID NO: 259 - DNA, 46 bp, Homo sapiens
ctatcttctttttcttcagcgaggcggccgagctgacgcaaacatg

SEQ ID NO: 260 - DNA, 70 bp, Homo sapiens
cggcctccgccaccatcttgctttcctttaatccggcagtgaccgtgtgtcagaacaatcttgaatcatg

SEQ ID NO: 261 - DNA, 539 bp, Homo sapiens
ctgcctttcgtgtctctgcagcgtggagactggaaccggcaatttcaaaggacgccacgttcaatcgcagcgctggcgcgggcggaggctaaaacacgggggtcctgagactgaggaaaacgcgccaagttcccctcggtggcggagtgctaaagaccctagcggttcaggcgttcggcgagcggggccgctgcttgttgcgctcctggctctcccggggcgggcgcagatgggcgccgctcccgggatgtagttggtgttggtgcaagacgggagcgagcggcggtcggggttcccgctcttgggagcggatggtcactcccccgcggggagggcgagccgaccagattttcctggggccggggacccggcgggctcggggcagggactcacctgtcgcacccacactcattcgggttggacttgccggcgtcaccgccgcggacttcgctttgggccatgaccagatataattggtgattacaactttcctctataaattaactcttgacactccttgggatttgaagaaaaaaatg

SEQ ID NO: 262 - DNA, 143 bp, Homo sapiens
gtgtctccttcacttcgccctccagctgctggagctgcagcccgaccgcgagcgtgccaagcggcttcagcagctagcggagcggtggcggcggcccccctcaggacaccaccagattcccctcttcccgcggcctcgccatg

SEQ ID NO: 263 - DNA, 68 bp, Homo sapiens
gcctcttctccgggagccagtccgcgccaccgccgccgcccaggccatcgccaccctccgcagccatg

SEQ ID NO: 264 - DNA, 423 bp, Homo sapiens
ccccctccccgctgctcaccccgctctccggccgccgccggtgcgggtgctccgctaccggctcctctccgttctgtgctctcttctgctctcggctccccaccccctctcccttccctcctctccccttgcctcccctcctctgcagcgcctgcattattttctgcccgcaggctcggcttgcactgctgctgcagcccggggaggtggctgggtgggtggggaggagactgtgcaagttgtaggggagggggtgccctcttcttccccgctcccttcccccgccaactccttcccctccttctccccctttcccctccccgcccccaccttcttcctcctttcggaaggactggtaacttgtcgtgcggagcgaacggcggcggcggcggcggcggcggcaccatccaggcgggcaccatg

SEQ ID NO: 265 - DNA, 283 bp, Homo sapiens
agtcctttgctcgccggcttgctagctctctcgatcactccctcccttcctccctcccttcctcccggcggccgcggcggcgctggggaagcggtgaagaggagtggcccggccctggaagaatgcggctctgacaaggggacagaacccagcgcagtctccccacggtttaagcagcactagtgaagcccaggcaacccaaccgtgcctgtctcggaccccgcacccaaaccactggaggtcctgatcgatctgcccaccggagcctccgggcttcgacatg

SEQ ID NO: 266 - DNA, 95 bp, Homo sapiens
cagcctctaccttgcgagccgtcttccccaggcctgcgtccgagtctccgccgctgcgggcccgctccgacgcggaagatctgactgcagccatg

SEQ ID NO: 267 - DNA, 155 bp, Homo sapiens
gggcctttgtctctggctgcagttggagctctgcgtctcgtcttcgttcttctgtgtcctctgctgctagaggtccagcctctgtggctctgtgacctgcgggtattgggggatccacagctaagacgccaggaccccccggaagcctagaaatg

SEQ ID NO: 268 - DNA, 448 bp, Homo sapiens
cagtccttttgtgggagtccggtctgtccacttgccggtccctcagaccgtcggcggtctctgtccgcttcgggacctgtccgctggtcgctccgcgtccgatggctcctggccgcggaaccttaggcctggccctggtctccgagcgcgggttcgccgggaggagcgtgtggcgggggtgtgccggggcgtgagtgcgccgagcatggggctgagcctggtgtggggagtgggtatctgcggagccggcctgaaccccacctcagccgggcgcggggagggggctccgtgcgtgtgatcgtgcagctgtgagcgcgtggccgccccgcggggctccgctgcaggcccctcagccccaggagcagtactcgctcttcagggcctgccctggatcctggaggctacacagctgcccactcctcctggggaggctgccgtggaggccatg

SEQ ID NO: 269 - DNA, 155 bp, Homo sapiens
gggcctttgtctctcgctgcagcctgagctctaggtcttgttttccctgctttgtgttttctgctcgtggacgcccagcctctgtggccctgtggcctgcaggtattgggagatccacagctaagacgccgggaccccctggaagcctagaaatg

SEQ ID NO: 270 - DNA, 128 bp, Homo sapiens
gggcctttgtctctcgctgccgccggagtttccaggtctcgacttcactgctctgtgtcctctgctccaggaggcccagcctgtgtggccctgtgacctgcaggtattggagagccacagctaagatg

SEQ ID NO: 271 - DNA, 176 bp, Homo sapiens
gggtctttgcgtctggctactaccagaccgcgggttaggggcttcatctctctgcgttctcagttgtgggaggccttggtgattcggccacagcctcagcctccgtcgctctgtgacctgcgggtattggatgattggtagctaagactcccgaatacttcagaagtggggaaatg

SEQ ID NO: 272 - DNA, 29 bp, Homo sapiens
tgttctttctagctctgaaatagaaaatg

SEQ ID NO: 273 - DNA, 305 bp, Homo sapiens
ctcccttttcggagatttgaatttcccccagcgaggcgagtgaggcgaaatacccgtatggtgatagctggccttttcgcgccaatactgaaaaaggcagaacgttcctccgctggcgccagccaatcagcaggactcctgccttccttcggggcaaggtcgcagcatctgcctcggaaatcacgaaatcacggggcttctttctgctggctcagccgggaggcccagagtgttctgcagaggctgcgtattgaaggctgctctctgaagctccctgccccaggtcacgccgccggttccagatg

SEQ ID NO: 274 - DNA, 45 bp, Homo sapiens
acttcttttcttggctaagccgcgtttgtactgtgtcttaccatg

SEQ ID NO: 275 - DNA, 171 bp, Homo sapiens
ccgcctttgcgctgcgcgcctgcgcccgcgccggcttccagcgggtgtcggacctgagagctggaggggcgtgcgcgcgccctcgctctgttgcgcgcgcggtgtcaccttgggcgcgagcggggccgcgcgcgcacgggacccggagccgagggccattgagtggcgatg

SEQ ID NO: 276 - DNA, 243 bp, Homo sapiens
cctcccccttccccggctggggcggctggagagccgggagtcgctgggtgcgtggggctgcctcgccgcgtctcgccacgggctctgccagcagacagccttggcacacaggcacaagggctggagcccagagatgagagtgcccaagggagatgtgagcctggcgggctgcccgctaacctgtcgctgaagccccagaagcgggccctcaggccaggcctaccctgcctccggcccagcatg

SEQ ID NO: 277 - DNA, 687 bp, Homo sapiens
aagcctcttttatacatctcttcagggaagagagaagcaatgggcatgttagtatacaatgatcacagccacgcaggcctgcaagctgccttttggacaggctgttgactgccgttccaattagctgattggagaatgtggaatgcagagtgataatgctgcatatctgctatcaggcagcagcaaaggtttttgtcttgggaaggcaagctttccctgcaatattatctcagcagctccctagctgcttaccctgaaaacgagggatccaaacggagggtgttgcactctgctaacgctggtcctgtgcgtggctgtggcatatgagcggcaggtctgaaaaagcaggtgtgtgctgggacgggcactggactggaacgcaggcggacgctctcgggtttacctgcttcctgttaacagattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatg

SEQ ID NO: 278 - DNA, 540 bp, Homo sapiens
gtttctcttcttgacttgatgcaggcacagatttatcaagctcctcagtcaacaaacacatcaccggaagaaatatggaaggaaaggaattttaaaaggaaataccaatctctgtgcaaacaaagccttgtatattcatgtttgcaccaatctactgtgagatttatgaagaaaaacaaattgcggacaactctctatgtacacttacaaatgcctcagttgatgcttgtgggctgtttgtcagcgttctgtgataatgaacacatggacttctgtttattaaattcagttgacccctttagccaattgccaggagcctggatttttacttccaactgctgatatctgtgtaaaaattgatctacatccaccctttaaaagcattgatgaattaattagaactttagacaacaaagaaaaattgaaaaagaattctcagtaaaagcgaattcgatgttcaaaacaaactacaaagagacaagacttctctgtttactttctaagaactaatataattgctaccttaaaaaggaaaaaatg

SEQ ID NO: 279 - DNA, 33 bp, Homo sapiens
gggccttcctgcaacctttgcggctccaacatg

SEQ ID NO: 280 - DNA, 270 bp, Homo sapiens
gcttctttgcagcgcttcagcgttttcccctggagggcgcctccatccttggaggcctagtgccgtcggagagagagcgggagccgcggacagagacgcgtgcgcaattcggagccgactctgggtgcggactgtgggagctgactctgggtagccggctgcgcgtggctggggaggcgaggccggacgcacctctgtttgggggtcctcagagattaatgattcatcaagggatagttgtacttgtctcgtgggaatcacttcatcatg

SEQ ID NO: 281 - DNA, 37 bp, Homo sapiens
ctgccttcgccgctcgggccgcccgggggaaaacatg

SEQ ID NO: 282 - DNA, 237 bp, Homo sapiens
ccgcctcctctaggccgccggccgcgaagcgctgagtcacggtgaggctactggacccacactctcttaacctgccctccctgcactcgctcccggcggctcttcgcgtcacccccgccgctaaggctccaggtgccgctaccgcagcgtgagtacctggggctcctgcaggggtccactagccctccatcctctacagctcagcatcagaacactctctttttagactccgatatg

SEQ ID NO: 283 - DNA, 109 bp, Homo sapiens
ccttccttacttccggttctctatggtgcgcgggcaagctttgctccgcctccggcagtggcttactcccggtgccaggttcttggagctgtgaggaggaacaaccatg

SEQ ID NO: 284 - DNA, 112 bp, Homo sapiens
gggcctttgcaaaattgccctagtaacggccgcatggtaactcaggcgccgggcgcactgtcctagctgctggttttccacgctggttttagctcccggcgtctgcaaaatg

SEQ ID NO: 285 - DNA, 153 bp, Homo sapiens
tttcctttttagttgactgaaacaaaacaaaacaaaagggccactggatgtctgccttcttggggggtgagccagacagactgacaaacaaacagccccaactgtgttcgggggagggtttcgcctcccgttttgcccggcagcagcagcatg

SEQ ID NO: 286 - DNA, 250 bp, Homo sapiens
gctccccttttgccttcaaccttcgagccgccacgtaatgccacgtccccgcgcatgcgcatcttggccgctgctggcggctgtttccgggcttagagggctggagtggccgccgagttggaggcggtggtggcagcagtaggagtgtgtagagtgcgggattgggggccaggccctgcggagggcgggggaagttgtcttcttttttttccggaggggccggtaaacctggtggctgaacggcaagatg

SEQ ID NO: 287 - DNA, 171 bp, Homo sapiens
cccccttttggcccctgcctttggagaaagtggagtgtggcgcttggttgtcgttatttcttcggactgcttcgcggtgcacggattcagcttctgcccagtggggctttcagctgtttgcgcgtctctctgtccccctcccctccccccggcacacctctgtctacgatg

SEQ ID NO: 288 - DNA, 145 bp, Homo sapiens
gcttcttccgctttctcgtcaggctcctgcgccccaggcatgaaccaaggtttctgaactactgggcgggagccaacgtctcttctttctcccgctctggcggaggctttgtcgctgcgggctgggccccagggtgtcccccatg

SEQ ID NO: 289 - DNA, 152 bp, Homo sapiens
ggctccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatg

SEQ ID NO: 290 - DNA, 109 bp, Homo sapiens
gtttcctcttttcctggtttctcaagagtgctgctgctaacgcggtccccggcacgcaccatctgttgccatcccggccggccgaggccattgcagattttggaagatg

SEQ ID NO: 291 - DNA, 26 bp, Homo sapiens
ccgcctccttctttctcgacaagatg

SEQ ID NO: 292 - DNA, 47 bp, Homo sapiens
cgctctctggccgggcttgggctgcgtggagaatactttttgcgatg

SEQ ID NO: 293 - DNA, 33 bp, Homo sapiens
gtttctctttcttcctgtctgcttggaaagatg

SEQ ID NO: 294 - DNA, 55 bp, Homo sapiens
aaaccttttccggtcttactcacgttgcggccttcctcgcgtcacagccgggatg

SEQ ID NO: 295 - DNA, 36 bp, Homo sapiens
ctccctctcacacacgctcacacccggctcgagatg

SEQ ID NO: 296 - DNA, 846 bp, Homo sapiens
ccgcctctctccgccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatg

SEQ ID NO: 297 - DNA, 252 bp, Homo sapiens
agctctttcgcggcgctacggcgttggcaccagtctctagaaaagaagtcagctctggttcggagaagcagcggctggcgtgggccatccggggaatgggcgccctcgtgacctagtgttgcggggcaaaaagggtcttgccggcctcgctcgtgcaggggcgtatctgggcgcctgagcgcggcgtgggagccttgggagccgccgcagcagggggcacacccggaaccggcctgagcgcccgggaccatg

SEQ ID NO: 298 - DNA, 147 bp, Homo sapiens
ctttcttttctccaagacgggctgaggattgtacagctctaggcggagttggggctcttcggatcgcttagattctcctctttgctgcatttccccccacgtcctcgttctcccgcgtctgcctgcggacccggagaagggagaatg

SEQ ID NO: 299 - DNA, 210 bp, Homo sapiens
tggtcttctctcccgcggcgctggggcccgcgctccgctgctgttgctccattcggcgcttttctggcggctggctcctctccgctgccggctgctcctcgaccaggcctccttctcaacctcagcccgcggcgccgacccttccggcaccctcccgccccgtctcgtactgtcgccgtcaccgccgcggctccggccctggccccgatg

SEQ ID NO: 300 - DNA, 75 bp, Homo sapiens
ttttctttctttcttagctgttagctgagaggaagtctctgaacaggcggcagcggctcttatagtgcaaccatg

SEQ ID NO: 301 - DNA, 72 bp, Homo sapiens
gatcctttttgtcccctactgcgtgcggtggcagcttccttgcggaagtggtgaccgtgagagaagaagatg

SEQ ID NO: 302 - DNA, 133 bp, Homo sapiens
gtttcctttcgctgatgcaagagcctagtgcggtggtgggagaggtatcggcaggggcagcgctgccgccggggcctggggctgacccgtctgacttcccgtccgtgccgagcccactcgagccgcagccatg

SEQ ID NO: 303 - DNA, 156 bp, Homo sapiens
cctcccctctccgcctaagcctgccctatgccagccgggtgtcctccccacagcaccacggcttctcttcctcagcacggcgacaggggcttccccttcgccgccgccgccgccgccggccaagctccgccgcgcccgcggcccgcggccgccatg

SEQ ID NO: 304 - DNA, 91 bp, Homo sapiens
cgcccccttctgcgcggtcacgccgagccagcgcctgggcctggaaccgggccgtagcccccccagtttcgcccaccacctccctaccatg

SEQ ID NO: 305 - DNA, 578 bp, Homo sapiens
ctccctttcttaaatgcttggggtgagagagaagagaggctagggtggggcatggaggacacagagagagagagtgctgtgtattccttccccgctactgtcctgtcctcagctaacttgctctgggacagcttccccagggctacagatactgcactcagctgactgtcctttcttctgggcccctggtcccagagcagagctgacaaaggagattcctgagagagcaccttcttatcacagaaagtgctgagccaagagctcctagctgccccttttgcagatgtgaagggccagtgaaccttggacccagatggttgcttaatactcctttccccctccctcactccttcctttgcgggctgcctcacctcctccacccttcttgcttaaatccataggcatttgtctggccttcccttttactgctggctgggaaggaggagcatcagaccacagatcctggaaggcacttctctccctgactgctgctcacactgccgtgagaacctgcttatatccaggaccaaggaggcaatgccaggaagctggtgaagggtttcctctcctccaccatg

SEQ ID NO: 306 - DNA, 89 bp, Homo sapiens
ctcccttttctcctcaagtcctgaagttgagtttgagaggcgacacggcggcggcggccgcgctgctcccgctcctctgcctccccatg

SEQ ID NO: 307 - DNA, 74 bp, Homo sapiens
agccctcctacctgcgcacgtggtgccgccgctgctgcctcccgctcgccctgaacccagtgcctgcagccatg

SEQ ID NO: 308 - DNA, 86 bp, Homo sapiens
ccttctttgcggctcggccattttgtcccagtcagtccggaggctgcggctgcagaagtaccgcctgcggagtaactgcaaagatg

SEQ ID NO: 309 - DNA, 217 bp, Homo sapiens
cggccccttcggctccgagctgaccctgatcagggccgagttgtctcggcggcgctgccgaggcctccacccaggacagtccccctccccgggcctctctcctcttgcctacgagtcccctctcctcgtaggcctctcggatctgatatcgtggggtgaggtgagcaggcccggggagggtggttaccgctgaggagctgcagtctctgtcaagatg

SEQ ID NO: 310 - DNA, 71 bp, Homo sapiens
agctctcttcttgcttggcagctggaccaagggagccagtcttgggcgctggagggcctgtcctgaccatg

SEQ ID NO: 311 - DNA, 479 bp, Homo sapiens
ttttcttcttcgtcagcctcccttccaccgccatattgggccactaaaaaaagggggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatttgatcagcggagactcggcggccgggccggggcttccccgcagcccctgcgcgctcctagagctcgggccgtggctcgtcggggtctgtgtcttttggctccgagggcagtcgctgggcttccgagaggggttcgggctgcgtaggggcgctttgttttgttcggttttgtttttttgagagtgcgagagaggcggtcgtgcagacccgggagaaagatg

SEQ ID NO: 312 - DNA, 540 bp, Homo sapiens
tctcctcttcttcctttgtgtgtgcgcgagcggagttggggcggagggagaagggggaggtcgctctgtctgtccgtctcccgccgcctctgcccggtctactcgaagtgcggcgggagaggcgggagcccaggagagggtgcgggagctggcggggcggctcggagctgccaggacgccctggtcccagccgcgcacaggggagcgtggacggcagaggggctcggcgggagccgagatccgcccgtcccggctgcccctcggcctccctctgctcccacctaccccctgacacccatagaaaagcgtgcaaaggcgcggagcgggacggaaaccacaaataaatagcggcggcggcagcgcgtcatctggtggagcaggaagtgcaggcagagtccggaggctggtgctttctgcgcgtccccaggactttgccatgggctgggggccgcggaggctgcgagcggccgggcgagggcagcggcggcggcgtccgcaccggggctgagcgagcagcgacgcgaggggcgcgcggagatg

SEQ ID NO: 313 - DNA, 466 bp, Homo sapiens
gggcctccttgaggaccccgggctgggcgccgccgccggttcgtctactctttccttcagccgcctcctttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaaggcacccagtggcaagtactagctgagcatttgggagatgcttgtcttacttggctgttgcttctcctgctgctggggaaaaggaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatg

SEQ ID NO: 314 - DNA, 114 bp, Homo sapiens
atttcttttcaagtcaattgaactgaaatctccttgttgctttgaaatcttagaagagagcccactaattcaaggactcttactgtgggagcaactgctggttctatcacaatg

SEQ ID NO: 315 - DNA, 68 bp, Homo sapiens
cagtctccctcccttctggagacaccaccagatgggccagccagaggcagcagcagcctcttcccatg

SEQ ID NO: 316 - DNA, 54 bp, Homo sapiens
cgctctccgcctcgcttgctcctgccgggcgtgcagggccccgccgccgccatg

SEQ ID NO: 317 - DNA, 180 bp, Homo sapiens
catcctttccctgcggaggaccagggcaagtttcctgcctgcacggcacaggagagcaaacttctacagacagaccaaggcttccatttgctgctgacacatggaactgaggtgaaattgtgctccatgattttacagatttcataacgtttaagagacgggactcaggtcatcaaaatg

SEQ ID NO: 318 - DNA, 15 bp, Homo sapiens
cgtcctctcagcatg

SEQ ID NO: 319 - DNA, 247 bp, Homo sapiens
ttacctctttttcttgtctctcgtcaggtctctgacattgacagagcctggacgttggaggaagccccaggacgttggaggggtaaagtaaaagtccacagttaccgtgagagaaaaaagagggagaaagcagtgcagccaaactcggaagaaaagagaggaggaaaaggactcgactttcacattggaacaaccttctttccagtgctaaaggatctctgatctggggaacaacaccctggacatg

SEQ ID NO: 320 - DNA, 72 bp, Homo sapiens
cgctctttctcccttcagcagccagccagctctgtgtcagggtcggggggtgcagaaagtcaggacagaatg

SEQ ID NO: 321 - DNA, 161 bp, Homo sapiens
gttcctcttttcctcggttcccagtgttctggcaggtaaggaacgccggctcttcgcctctcagcgcggcttgtcctttgttccggacgcccgctcctcagccctgcggctcctggggtcgctgctgcatcccgcacgcctccaccggctgcagacccatg

SEQ ID NO: 322 - DNA, 78 bp, Homo sapiens
cgctccctcccggtgccggcttctctgagtcaccaacctgaggctgccccggccgcctgcgcacccggcagcaccatg

SEQ ID NO: 323 - DNA, 59 bp, Homo sapiens
agctctttgccgtcggagcgcttgtttgctgcctcgtactcctccatttatccgccatg

SEQ ID NO: 324 - DNA, 118 bp, Homo sapiens
cttccttctttcctcccttgccagtccgcctgtcttcctccccgtcttccctgcccggcctcccccttcttcccccgctggccccctccccggagggataatatggtctccggcgatg

SEQ ID NO: 325 - DNA, 182 bp, Homo sapiens
ccaccttcttttcatttctagtgagacacacgctttggtcctggctttcggcccgtagttgtagaaggagccctgctggtgcaggttagaggtgccgcatcccccggagctctcgaagtggaggcggtaggaaacggagggcttgcggctagccggaggaagctttggagccggaagccatg

SEQ ID NO: 326 - DNA, 96 bp, Homo sapiens
cattcctttctttcgattacccgtggcgcggagagtcagggcggcggctgcggcagcaagggcggcggtggcggcggcggcagctgcagtgacatg

SEQ ID NO: 327 - DNA, 152 bp, Homo sapiens
gagtcttttcagcgctgaggactggcgctgaggaggcggcggtggctcccggggcgtttgagcgggctcacccgagcccgcgggccaacgcggatccaggcccgactggcgggaccgccccggattccccgcgggccttcctagccgccatg

SEQ ID NO: 328 - DNA, 28 bp, Homo sapiens
atttctcctccccctcccggccaagatg

SEQ ID NO: 329 - DNA, 192 bp, Homo sapiens
ggtcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagatg

SEQ ID NO: 330 - DNA, 23 bp, Homo sapiens
ctaccttccttctagcagaaatg

SEQ ID NO: 331 - DNA, 268 bp, Homo sapiens
cggcccttcctccgccttctgggcggagcccgcgcgggatccgggtggctgcaggctgctggcttctgcggctgcggggtcggggtcgcggccagggccaagccgcagcgagttcacaggcggaacccctgcaggcggcgccccctacgcgaggtcacccctgggaaggagcgcagcccacccggcccctccgcatccgagcaggacgcccgtctcctctccctgaggatttcaggtctccctgtcccaggaggcttgtgccaagatg

SEQ ID NO: 332 - DNA, 34 bp, Homo sapiens
tcttctctcggttcctctttcctcgctcaagatg

SEQ ID NO: 333 - DNA, 56 bp, Homo sapiens
ggctcttctttgcctctgctggagtccggggagtggcgttggctgctagagcgatg

SEQ ID NO: 334 - DNA, 68 bp, Homo sapiens
ttttcctttagtcaggaaggacgttggtgttgaggttagcatacgtatcaaggacagtaactaccatg

SEQ ID NO: 335 - DNA, 81 bp, Homo sapiens
gcttctcttttccttggcggaggagggagaccacagagccctgggttgtggaagaggtggctgttccctgtcatcagtatg

SEQ ID NO: 336 - DNA, 292 bp, Homo sapiens
cccccttcccccgcctttcttccctccgcgacccgggccgtgcgtccgtccccctgcctctgcctggcggtccctcctcccctctccttgcacccatacctctttgtaccgcaccccctggggacccctgcgcccctcccctcccccctgaccgcatggaccgtcccgcaggccgctgatgccgcccgcggcgaggtggcccggaccgcagtgccccaagagagctctaatggtaccaagtgacaggttggctttactgtgactcggggacgccagagctcctgagaagatg

SEQ ID NO: 337 - DNA, 261 bp, Homo sapiens
gagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatg

SEQ ID NO: 338 - DNA, 243 bp, Homo sapiens
gcgcctcttaggcttggcggtggcggcggcggcagcttcgcgccgaatccccggggagcggcggtggcggcgtcctggggccaggaggagcgaacacctgccgcggtcctcccgccggcgctgggctctgtgtgctccgggatggagcaggtgtgcagagggtgagaacccagctctgggaccaagtcacttgcttccttacttagcaagactatcgacttgagcaaacttggacctgggatg

SEQ ID NO: 339 - DNA, 526 bp, Homo sapiens
ccccctcttttggttacagacgtgagggctctttggagacgtaaacatctccgagtggcgagggtgggcggggctgggcttgggaaagggcggggtggcttgcttgaggtgtggaaagaccagaagaaggtgaggtcaagagagtgcagaatgaggcattccaatggtgggtgggccctgacctgagagagtggcgcggggaggggtgaaagcgcggcgatcctggaacgccagcgggcgttgcggcctatgcgcgaggggcggggcgattaggtcatagagcggctcccagcgttccctgcggcgtaggaggcggtccagactataaaagcggctgccggaaagcggccggcacctcattcatttctaccggtctctagtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatg

SEQ ID NO: 340 - DNA, 251 bp, Homo sapiens
gctcctctgcgcccttgccgccctccgagccacagctttcctcccgctcctgcccccggcccgtcgccgtctccgcgctcgcagcggcctcgggagggcccaggtagcgagcagcgacctcgcgagccttccgcactcccgcccggttccccggccgtccgcctatccttggccccctccgctttctccgcgccggcccgcctcgcttatgcctcggcgctgagccgctctcccgattgcccgccgacatg

SEQ ID NO: 341 - DNA, 78 bp, Homo sapiens
cttcctttcgcggggtcctccgtagttctggcacgagccaggcgtactgacaggtggaccagcggactggtggagatg

SEQ ID NO: 342 - DNA, 357 bp, Homo sapiens
gctcctcctcgtcccagcgctagcgggcacgcggttcctttttgcgagctttccgagtgccaggcgccggccggctgcgaagacgcggtgggccgcccctccgattgaaatcacagaagatattcgtgttcttcttaagagaaaaagaggacattttagctttctcagttgaaggcgtactttattgtcggcttccaaagattactaacttttatctgtatcactaagattgaactgccttggctgtactgctattcttactgctgcttctattattgccttcttcagcacaataaggctttcaaaagccaaagaataacaagaaataagcaccattttagaagcctttccactatg

SEQ ID NO: 343 - DNA, 86 bp, Homo sapiens
tggtccttttcaacggttttcacagatccagtgacccacgctctgaagacagaattagctaactttcaaaaacatctggaaaaatg

SEQ ID NO: 344 - DNA, 303 bp, Homo sapiens
ctgcctctccaggcaacgcgggaggcccagcgggaaggcaggaggcggcggcggaggaggagctctactgagccgcaactgtggcgacagcaaccggagtcgcagccgccgccacctgcacctggcgcctagcccacgtccagcgcctgcccggccgccgcttcccgccaccctgccctgcccacccgccaggtactaccattaaagataccttcttctcagcaaatctatgataaaaaatataagtaacagaagaagaaataactgttatttgtcaagtgacaagcttttaatgtcagaatg

SEQ ID NO: 345 - DNA, 107 bp, Homo sapiens
acgtctcttgctcctcagggccactgccaggcttgccgagtcctgggactgctctcgctccggctgccactctcccgcgctctcctagctccctgcgaagcaggatg

SEQ ID NO: 346 - DNA, 78 bp, Homo sapiens
acgcctcttcagttgtctgctactcagaggaaggggcggttggtgcggcctccattgttcgtgttttaaggcgccatg

SEQ ID NO: 347 - DNA, 146 bp, Homo sapiens
gggtcttttttagcgccatctgctcgcggcgccgcctcctgctcctcccgctgctgctgccgctgccgccctgagtcactgcctgcgcagctccggccgcctggctccccatactagtcgccgatatttggagttcttacaacatg

SEQ ID NO: 348 - DNA, 115 bp, Homo sapiens
cgctctctgatgcaacgccggaatcgcggaaaccgccggtgcacgttggagtcataagacggcgtcggtgttgcagtctgtgtccttggaggtgaccagggccactgcaggcatg

SEQ ID NO: 349 - DNA, 43 bp, Homo sapiens
cgtccccttgggtccttgatcctgagctgaccgggtagccatg

SEQ ID NO: 350 - DNA, 35 bp, Homo sapiens
ttctccttcccgcagtctgcagccggagtaagatg

SEQ ID NO: 351 - DNA, 91 bp, Homo sapiens
catcctttacggcaggcgtccgcgtcgctagctagtcgttctgaagcggcggccagagaagagtcaagggcacgagcatcgggtagccatg

SEQ ID NO: 352 - DNA, 133 bp, Homo sapiens
ccctcctttttaagcgcctcccgccagcctctgctgtggctcgcttcgccgcgctccctccttccccgccttccatacctccccggctccgctcggttcctggccaccccgcagcccctgcccaggtgccatg

SEQ ID NO: 353 - DNA, 146 bp, Homo sapiens
ctcccttcgcgctccggacgggcgacggtagctcgagacccgggactccgcccgcctccccgcgagtatttgaggtccggggcggctccggcgcctctgcccgccgttctgctcgctcgctccccgctctggagtctgccatcatg

SEQ ID NO: 354 - DNA, 69 bp, Homo sapiens
ttctctcctcagacttcaagggctaccactggacccttcccctgtcttgaaccctgagccggcaccatg

SEQ ID NO: 355 - DNA, 25 bp, Homo sapiens
ctctctcctttccctgttagacatg

SEQ ID NO: 356 - DNA, 213 bp, Homo sapiens
agttctctccgcacgcgggctggagaagcgggtcctacgcacgctttgttgtcgcgctttgcctccgtccttgcccctactcccgccttacctgacttccttttcggaggaagatccttgagcagccgacgttgggacaaaggatttggagaaacccagggctaaagtcacgtttttcctcctttaagacttacctcaacacttcactccatg

SEQ ID NO: 357 - DNA, 173 bp, Homo sapiens
cgccctttctgtgcggcgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatg

SEQ ID NO: 358 - DNA, 242 bp, Homo sapiens
ctgccctttggacgcgcgcctcggttccgaacgcagcggacggcgcctcaggcagcgcggcggacagcccgtcctccggcgcgccgcgagcctcggaggaccctagcgacggtcgtggcgtaagaccggggggacgcggcggtagcggcggccgttgcgattgattgcgctggttgcctgcggcgtccacttccttggccgcccttgctacactggctgattgttgtgcagccggcgccatg

SEQ ID NO: 359 - DNA, 425 bp, Homo sapiens
ccaccctttctcgaggctgtggcctccgcgagagccgagcgggccgcaccgccggccgtgcgactgccccagtcagacacgaccccggcttctagcccgcctaagcctgtttggggttgctgactcgtttcctccccgagtttcccgcgggaactaactcttcaagaggaccaaccgcagcccagagcttcgcagacccggccaaccagaggcgaggttgagagcccggcgggccgcggggagagagcgtcccatctgtcctggaaagcctgggcgggtggattgggaccccgagagaagcaggggagctcggcggggtgcagaagtgcccaggcccctccccgctggggttgggagcttgggcaggccagcttcacccttcctaagtccgcttctggtctccgggcccagcctcggccaccatg

SEQ ID NO: 360 - DNA, 185 bp, Homo sapiens
ttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatg

SEQ ID NO: 361 - DNA, 29 bp, Homo sapiens
ccgccctttcgctcctcggccgcgcaatg

SEQ ID NO: 362 - DNA, 368 bp, Homo sapiens
agctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagatctggaaagcatg

SEQ ID NO: 363 - DNA, 65 bp, Homo sapiens
ctcccttttcagtccgcgtccctccctgggccgggctggcactcttgccttccccgtccctcatg

SEQ ID NO: 364 - DNA, 62 bp, Homo sapiens
ggtccttctctggggcggtcgcgttggcagcggatgcgggaagccggactctgggcgtcatg

SEQ ID NO: 365 - DNA, 136 bp, Homo sapiens
cgccctctcagcaacccgcacagggcgcacccggacgctctaccgctcccgccgcagtcgccgggccatgggcctcgagcccgccccgaacccccgcgagcccgccttgtctgcggcgtgactggaggcccagatg

SEQ ID NO: 366 - DNA, 79 bp, Homo sapiens
cgttcttttgttccggggccgcagggcggggcaggcccgactttcgccgtcttcttgtctactctccagaacggccatg

SEQ ID NO: 367 - DNA, 117 bp, Homo sapiens
cttcctctccgcctccttcgcctagcctgcgagtgttctgagggaagcaaggaggcggcggcggccgcagcgagtggcgagtagtggaaacgttgcttctgaggggagcccaagatg

SEQ ID NO: 368 - DNA, 63 bp, Homo sapiens
ctacctcttcctctccacgcggttgagaagaccggtcggcctgggcaacctgcgctgaagatg

SEQ ID NO: 369 - DNA, 404 bp, Homo sapiens
tgctctctgccgcattgatagcagcgagagctggaggtgttgggtcgggagaccagccgttcgatcccgccgcaggtaggagctggtttccatcctggcaccacggcacacacctccagcctcgagcccggcgctgctgcccgggggtctccttcaggctctttgacgccgttccagggggcacctatccaggcatcctctgggcctctagccagaggactggctcccggcttcagcactccgggctgcagtaagaagtgcccttatcgctctgagccctgccaccatcccgtgaaccaccgaaaccctggtccagcgcgacagccttggacctgggactggacggatccaaaacgctcagcctcggccccccacagacggggctctgcatcgtctctgatatg

SEQ ID NO: 370 - DNA, 41 bp, Homo sapiens
tgctcttcctgggctggctgtctcctgctcatccagccatg

SEQ ID NO: 371 - DNA, 152 bp, Homo sapiens
ctgtctttctagcatgttgccctttttcaaccacatttgtgtttcaggtgtagagaggagagagagtgaacagggagcggggcttttgtctgttggtctccctggactgaagagagggagaatagaagcccaagactaagattctcaaaatg

SEQ ID NO: 372 - DNA, 55 bp, Homo sapiens
gcttctctgctgaccctctctcgtcgccgctgccgccgccgcagctgccaaaatg

SEQ ID NO: 373 - DNA, 42 bp, Homo sapiens
cctccttctgtttcccagaccgagagccgcgccggcaccatg

SEQ ID NO: 374 - DNA, 152 bp, Homo sapiens
ccccctcttctccgcgtaggcccagctccctgaagcggctgtttcgagccacgcgcccatcgggtaccgaggcacgcgccgggcgtcacgtgcgtttcgcggcgagcggaaatgacgcgagttgtgtgagccgccagtatggccgggctatg

SEQ ID NO: 375 - DNA, 182 bp, Homo sapiens
ctgtctctccccatccggggcagcggggaatggctgagccaggggttcgccgcccccgccgccgccgccgccgccgccgccgccgccgccgcccgctttcggctcgggcctcaggaccgtagcatcctgagacattttgaattgacacttctcaagatttgactggatcagagttcatcatg

SEQ ID NO: 376 - DNA, 106 bp, Homo sapiens
cttcctttatctctggcggccttgtagtcgtctccgagactccccacccctccttccctcttgaccccctaggtttgattgccctttccccgaaacaactatcatg

SEQ ID NO: 377 - DNA, 118 bp, Homo sapiens
gagcctctgtcggccgcggaagcctggagtgggcggtacgcagacgcgcgcggtgagacccgctgtctgctcagcggactctgcccgcccccacctccccctgcgtcgggccgacatg

SEQ ID NO: 378 - DNA, 179 bp, Homo sapiens
caccctctttcagagtggtacatggaagacagcacaaagtggatccatactctgaaatgcagtaactctgatgcttgaatttgtctcccttcttgccagaaaggattctaataactcggtgtcaaagccaagacataaactcaaccccttctcttccaaaagcttcacgttacagcatg

SEQ ID NO: 379 - DNA, 92 bp, Homo sapiens
gtacctttctcggggtgtctgcgtaactgcccagacttgccttggtttggtcagatgacacctcctctgggactggctagccagcgttcatg

SEQ ID NO: 380 - DNA, 185 bp, Homo sapiens
tttcctctgctccgccgcggccggaggtatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatg

SEQ ID NO: 381 - DNA, 36 bp, Homo sapiens
ctttcttccgccttaggaaggtggcggccagggatg

SEQ ID NO: 382 - DNA, 817 bp, Homo sapiens
cggcccttttctcggggcgcccgagaggccagctcagacctcccggctcgacaggcggcgcgggcggcggtgagtgcggcgcggggacgccggggcgcggggaccagcgggagacagcggggggccggtggcgccagcacctgctgggggccccgggcactgagcccttggctggggcctcctgggatgccagggggcgcgggtcgggtcgcgggcatcgaggcgcggcggagggcgtgggggcccggccggggcggggtccggcctcccagcgctggtcccggccgcgtctccggttgggttcagctcctgcgtcccagagtggcccgatcgcgcgtggcggggtcgtccggcccccacccgaacgagcgcccttcgcggcccgccgcgtccccctccccggagaggacggcccctgggctttttagaaaaaggcgcgattctctctagtgactcaggttgagatttccagaaatatcccccgggggttcagaaacaaaaccaaaacaaacaaaaaaaccccaacgaattcccaaatgctatttgccaaacatttgacttctaggggcgcgggtacccgcgtttctctccctgcccccgcgacttcgcgcaagatccgggaaggacacccgaggcccctgggagaccctggggaggtgaaaatcagagagcgaagcgggccgtggcccctaggcctgacccctccccgcggggtaaggcgggcaccccgcgagcgcaggggtcctcttactgctgatggcacccagctctgggcccagacgccgctcaccgtccaccgccggtgctgggtaaaatg

SEQ ID NO: 383 - DNA, 264 bp, Homo sapiens
ccaccccttcggctctgggccccgcctcgtggtgccggctggttcttcgcgctcgcccgacttcccagcggccccgtgcggcccgggcatgcccagtgcgggcgcagcggccccggccctggaagcgccccggcggagctggcctgcggtgggctaggggcagggccggagccgcggcggcggagctgtggatccttcatgatgagagatttggggacacttctctctcctgtgtgtagttgatagtttggtggtgaagagatg

SEQ ID NO: 384 - DNA, 64 bp, Homo sapiens
tgacctttccgagttggctgcagatttgtggtgcgttctgagccgtctgtcctgcgccaagatg

SEQ ID NO: 385 - DNA, 91 bp, Homo sapiens
attcctccgcgcgctgggacaggctgcttcttcgccagaaccaaccggttgcttgctgtcccagcggcgccccctcatcaccgtcgccatg

SEQ ID NO: 386 - DNA, 222 bp, Homo sapiens
ctctcttccgcccggcggcccacaccggtcaggcccggcgcgggctgcgctctccagctgtggctatggccccagccccgagatgaggagggagagaactaggggcccgcaggcctgggaatttccgtcccccaccaagtccggatgctcactccaaagtctcagcaggcccctgagggagggagctgtcagccagggaaaaccgagaacaccatcaccatg

SEQ ID NO: 387 - DNA, 430 bp, Homo sapiens
cgaccttcctgccgggccgggcggtccgaggctgctggagtgccgtgagcaggccgcgggaacgtcgccgtcaccttgtctcggggcctcggcgctgcttcccgccaaaacacgtttaccgcgcgcccgggcctcccaccttgcggaagggaccccaccaccacttggatttctgttgcaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatg

SEQ ID NO: 388 - DNA, 184 bp, Homo sapiens
ccgcccctttccctcgccttcggctgacgctgacgtcggatgagtgatccggagggacgctccgaccgcggccgggaggctcctgggggccggggctccgaggttataatataacttatcctctcatgcttttttcctgccccttctccccaaatcatcaacaatagaagaagaagaaaacatg

SEQ ID NO: 389 - DNA, 57 bp, Homo sapiens
gtgtctctgtgggcggccgccgggttgagctgcggcacacgtgcgacggccgtgatg

SEQ ID NO: 390 - DNA, 31 bp, Homo sapiens
gtttcttttagtttccggtgtctctgcaatg

SEQ ID NO: 391 - DNA, 330 bp, Homo sapiens
cggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatg

SEQ ID NO: 392 - DNA, 22 bp, Homo sapiens
cggcctttgcggttccaacatg

SEQ ID NO: 393 - DNA, 273 bp, Homo sapiens
tagccttttcaaaaggcgcagcttaccgcggtgcgcgcggattctggacttgggcgccaactcgtagtccacgctccccggggtcagcagaggggcgctcacgctctcgccacccacctcgctttctcaccccgcgcttcccggcctgggtttttagtcttccttggagcgctctctggcctccgcctccgccagggagcggaaggcggagacagcgagactggccaggggggaggaaagaggacgcgtgtgggcaagggggacaacgggatg

SEQ ID NO: 394 - DNA, 81 bp, Homo sapiens
cgacctttcccctctgcgacagtttcccgaggtacctagtgtctgagcggcacagacgagatctcgatcgaaggcgagatg

SEQ ID NO: 395 - DNA, 311 bp, Homo sapiens
ggtcctctgcgccctggcagccaggagtcgccgccacgaccgccgggtctcagtgggtgcctgcgccttctccccgcccgcctgccccgggccatccagaaacttgctctacccgccgcgggtgctcggcagtgctgcccatggcccagcccaggagcctatttagggcgccggacgggctggacagaggcgcggctcagtaattgaaggcctgaaacgcccatgtgccactgactaggaggcttccctgctgcggcacttcatgacccagcggcgcgcggcccagtgaagccaccgtggtgtccagcatg

SEQ ID NO: 396 - DNA, 121 bp, Homo sapiens
ctgtctcttgtaggcagggatcacagtctgaaacgacagcaaggaagaggtaggcagggaaaactaactggaaggaagtttaaatacagaaagagcaaagtattatctaactataacaatg

SEQ ID NO: 397 - DNA, 190 bp, Homo sapiens
cttcctccagggtctggagaacccagaggcagctcctcctgagtgctgggaaggactctgggcatcttcagcccttcttactctctgaggctcaagccagaaattcaggctgcttgcagagtgggtgacagagccacggagctggtgtccctgggaccctctgcccgtcttctctccactccccagcatg

SEQ ID NO: 398 - DNA, 91 bp, Homo sapiens
cgctcttcctggttgggccctgccctgagctgccaccgggaagccagcctcagggactgcagcgacccccaaacacccctcccccaggatg

SEQ ID NO: 399 - DNA, 148 bp, Homo sapiens
cttcctttcgccgtcgccgccgcggagcggagtcgagccgagctgatttgatcgaggagcgcggttaccggacgggctgggtctatggtcgctccgcgggccgctccgccggctggtgcttttttatcagggcaagctgtgttccatg

SEQ ID NO: 400 - DNA, 81 bp, Homo sapiens
cttcctccctagtcgcggggagtctgagaaagcgcgcctgtttcgcgaccatcacgcacctcccctccgcttgtggccatg

SEQ ID NO: 401 - DNA, 293 bp, Homo sapiens
cctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatg

SEQ ID NO: 402 - DNA, 401 bp, Homo sapiens
aggcctttttgtgtcctgtttgctaaaggcatgcgggctacagcattcaagagagggagtcgttaacaaagggaaagagataaatgtaaataagctcacatttacagaatgagcggtttgcagtaaaaagctgcggcagcccagagtctgctactttaggctgggctaacctttccctgtaaaaaaaaaaaaaaaaaaaaaaaaaaaaaaatggataaaaatatgcacttccaaagggcgagttgcccatttacatgtttattagctaattatctacaggcatcagcacattctctcatctagcacactctttcttggggaggaaaatatttcctaccggtccatagtgtcagagtggtgaacccctgcagccagcaggcctcctgaaaaaaaagtccatg

SEQ ID NO: 403 - DNA, 188 bp, Homo sapiens
gctcctctttgcagagggggaaactcttgggctgagagcaggaataatgcggtaggcaaggcgggctgctggctcccccggctccggcagcagcggcggcagcccgagcagcggcagcagcagcggcagcaccccaggcgctgacagccccgccggccggctccgttgctgaccgccgactgtcaatg

SEQ ID NO: 404 - DNA, 187 bp, Homo sapiens
agccctttctgtccctcccagtgaggccagctgcggtgaagagggtgctctcttgcctggagttccctctgctacggctgccccctcccagccctggcccactaagccagacccagctgtcgccattcccacttctggtcctgccacctcctgagctgccttcccgcctggtctgggtagagtcatg

SEQ ID NO: 405 - DNA, 36 bp, Homo sapiens
gggtctcctcgctgtcgccgccgctgccacaccatg

SEQ ID NO: 406 - DNA, 198 bp, Homo sapiens
tcttctcctttaccaagatggcggcttgtccctgtttcgccacagttcctaccttatgagctcggttttcttatgcttataagagtggaacagcaaaagctggcaggctgacagaggcggcctcaggacggaccttctggctactgaccgttttgctgtggttttcccggattgtgtgtaggtgtgagatcaaccatg

SEQ ID NO: 407 - DNA, 58 bp, Homo sapiens
gttcctcccttcttccgagcctctcctctggccgccgcgcgggagagaggccgagatg

SEQ ID NO: 408 - DNA, 183 bp, Homo sapiens
ctacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatg

SEQ ID NO: 409 - DNA, 148 bp, Homo sapiens
cagtctttcgcctcagtctcgagctctcgctggccttcgggtgtacgtgctccgggatcttcagcacccgcggccgccatcgccgtcgcttggcttcttctggactcatctgcgccacttgtccgcttcacactccgccgccatcatg

SEQ ID NO: 410 - DNA, 218 bp, Homo sapiens
ccgcccctttctttctcctcgccggcccgagagcaggaacacgataacgaaggaggcccaacttcattcaataaggagcctgacggatttatcccagacggtagaacaaaaggaagaatattgatggattttaaaccagagtttttaaagagcttgagaatacggggaaattaatttgttctcctacacacatagatagggtaaggttgtttctgatg

SEQ ID NO: 411 - DNA, 106 bp, Homo sapiens
cagtctctcccagcgaccgccgcgggggcaaggcctggagctgtggttcgaatttgtgcaggcagcgggtgctggcttttagggtccgccgcctctctgcctaatg

SEQ ID NO: 412 - DNA, 581 bp, Homo sapiens
agttctttccaactttttctcggcggagtgagcgcagcgggcgcagactcgggggcaggttgctgtgcttctccgggctcagccgcctgctctcctggctcaggtcctcggggagccctagacagacatcaagtggccactggcgctccttcccctcccagctgagccatcctccccggcctcctcgggcgggacagccccgtgcttaggtttttctccttttctcccccggtgcgcctctgctcggactctcgcgccgggatcgcggcggaaacctccctcccctttcgcctcctgcggctccttcccttcgcccctcctccgccagtcactggaatcaattccgtggggaatcggctccgccgccgcgaaggacagcctttccgcgcgggactccggggcgccacgggggccatgtaagcagctatcttccagagggccacactgggcatggacacccttttccctgcctggaggagcacaggtgatagtgtaattttccagtcacgaaactgctaaggccatctcaggggcgtgtgcgccaggataggcgggcggcgtccgaggaccacatagccatg

SEQ ID NO: 413 - DNA, 218 bp, Homo sapiens
ctttcttttaagttgataacaatcagctcaggggtttgctctgcttgcaaggtcactgcaagaatgaacattgaactttggactatacctgaggggtgaggtaaacaacaggactataaatatcagagtgtgctgctgtggctttgtggagctgccagagtaaagcaaagagaaaggaagcaggcccgttggaagtggttgtgacaaccccagcaatg

SEQ ID NO: 414 - DNA, 103 bp, Homo sapiens
agctcttctcgcgcatgcgttctccgaacggtcttcttccgacagcttgctgccctagaccagagttggtggctggacctcctgcgacttccgagttgcgatg

SEQ ID NO: 415 - DNA, 120 bp, Homo sapiens
tttcctcttcctccccagcaccgacccacactgaccaacacaggctgagcagtcaggcccacagcatctgaccccaggcccagctcgtcctggctggcctgggtcggcctctggagtatg

SEQ ID NO: 416 - DNA, 29 bp, Homo sapiens
cctcctttccccagcccgccgcggccatg

SEQ ID NO: 417 - DNA, 97 bp, Homo sapiens
ggacctttcgcactcgggtcaggggtaaagcagcctgtcgcttgccgggcagctggtgagtcggtgacctggcctgtgaggagcagtgaggagaatg

SEQ ID NO: 418 - DNA, 175 bp, Homo sapiens
gtgcctctgactgtccgggtccctccagcattttgcagctttctcctgtcttgaagaagtagaacggtgcccgagaaacgtttttccccttcgagactcaggaggatgaaagtcatcacttgtgaaatagcctggcacaacaaggagcccgtgtacagcctggacttccagcatg

SEQ ID NO: 419 - DNA, 87 bp, Homo sapiens
agccccgccccgctcgctggcctgccctcctcttgctaccctcccggcgcagagaaccccggctgctcagcgcgctccgcggtcatg

SEQ ID NO: 420 - DNA, 65 bp, Homo sapiens
tgccctcctcttgctaccctcccggcgcagagaaccccggctgctcagcgcgctccgcggtcatg

SEQ ID NO: 421 - DNA, 176 bp, Homo sapiens
cagcctcctgccagcgcgctctctgtttctctgcagccccgaagctcgcgaatgtagcaggcgccccaagctcggtcctcaagaagccatggcggaatccaggggccgtctgtacctttggatgtgcttggctgctgcgctggcatctttcctgatgggatttatggtgggtaagt

SEQ ID NO: 422 - DNA, 46 bp, Homo sapiens
ctgtctctttaacgcgagaggaagcgatgcagaggggtggaaaatg

SEQ ID NO: 423 - DNA, 163 bp, Homo sapiens
cttccttttctgccttctctcctgctttctagctctgggctttcccagctccgaagtcaatactgagatcccagatgtgtccagagacatcctgaagaggctcgggggtggaggagccttagtgtgtccacaaagggactcctgaaactgactgagagccagt

SEQ ID NO: 424 - DNA, 20 bp, Homo sapiens
ggccctctggcgctaccatg

SEQ ID NO: 425 - DNA, 81 bp, Homo sapiens
cgcccttcccccacccgcttccggccgcggctcggttctcccgcctccgcctccgccgcggctcgtggttgtcccgccatg

SEQ ID NO: 426 - DNA, 67 bp, Homo sapiens
ctccctccttgcagttggatccctggcgggtgcggcccggcccggcccgtgagcggcgcacagaatg

SEQ ID NO: 427 - DNA, 93 bp, Homo sapiens
actcctcctttcccccgccccgcctccgttcggagagccggcgggcgggcgcctctcggccaggaagcgcctcttggacgcgtgtgaccgatg

SEQ ID NO: 428 - DNA, 248 bp, Homo sapiens
aggcctcttctgaggctctaggtgccccagtagcagggccttctgcagcaaggccgggaactgctgcaccattggtgtgttttaccttaagggactccaggcagcttccttgctgggaagatattcatttgctggggtggggctgggggtgcagaggtaggaagtgctgtggctagaaggcggcctggccagcgagtaggtggtggagcgagtgagagcgtgtgcgctgtaaacagtgtgagtgcatg

SEQ ID NO: 429 - DNA, 930 bp, Homo sapiens
aggcctcttctgaggctctaggtgccccagtagcagggccttctgcagcaaggccgggaactgctgcaccattggtgtgttttaccttaagggactccaggcagcttccttgctgggaagatattcatttgctggggtggggctgggggtgcagaggtaggaagtgctgtggctagaaggcggcctggccagcgagtaggtggtggagcgagtgagagcgtgtgcgctgtaaacagtgtgagtgcatgtgcgccagcgcgtgcaaggacacggtaagggatgtacatgtattgtctcgtgagtaagagcttgtgtgtgtgttgggatgggaagacacgtactggtatgagagcccgcgtgagaagtgtatgtgtgagtactcgcgtggaagttttgcactcgggtttgaggctgtgcaaaagtacgcatggctcaccaggtgtggggctgtgtgggctgcctcgtgtgtgccagcccgtgtgcaggcctgttttgtgagagccttcagggaacgcatgagcacgtgtgccagtgcgagtgcgggacgcggggaggcgggagagaccgagtgggaggccccgcgaaggagtgggagtgggagtgggagtgccggcgggagacctgcgggggcgcgcccgggctgacgcgtgcgcgccagtgcgcgtgagtgcgggcgcgcgccgccgccccccgccggggtcggagccggttgccatgggaacgcgccgcggcccgagttaatcatttcctgtggaaagtgtgcgggaggggcgcgagcgggctggccgaggaggaggcggcggcgtggagctgcctcctgccggcgggccgggccgggccgagccccgggcgctgcggcgacgcctggatcctgcctccgccaggccggctgcctggtgccccgaggaggctgctgagccccaggccatg

SEQ ID NO: 430 - DNA, 28 bp, Homo sapiens
cctcctccgcgttccagaatccaagatg

SEQ ID NO: 431 - DNA, 263 bp, Homo sapiens
cgttctctcccgcggaattcaggtttacggccctgcgggttctcagaggcaagttcagaccgtgttgttttcttttcacggatcctgccctttcttcccgaaaagaagacagccttgggtcgcgattgtggggcttcgaagagtccagcagtgggaatttctagaatttggaatcgagtgcattttctgacatttgagtacagtacccaggggttcttggagaagaacctggtcccagaggagcttgactgaccataaaaatg

SEQ ID NO: 432 - DNA, 383 bp, Homo sapiens
cttccttctgcaacaggcgtgggtcacgctctcgctcggtctttctgccgccatcttggttccgcgttccctgcacagtaagtactttctgtgccgctactgtctatccgcagccatccgcctttctttcgggctaagccgccccggggactgagagttaaggagagttggaggctttactgggccacagggttcctactcgcccctgggcctccggacaaaatggggtctgcggttggtgtcctggcaaaagcagggtagaagggctgcggggcgggcccagaatccgagcctgcagagatgggagcagttgcagtgttgagggcggaagaggagtgcgtcttgttttgggaactgcttcacaggatccagaaaaggaaatg

SEQ ID NO: 433 - DNA, 181 bp, Homo sapiens
cgcccttcgccgctgagctcgcagcctccggcgcccacctccacctccagtgtcccgcctcgggccgtcgccctccagcggctcgcgagcgtgggagacgtacctgggcaggcactgtccagcccaggcccaggcacagccgtgaggggcgaggcacggggacatcctggcggccaccatg

SEQ ID NO: 434 - DNA, 56 bp, Homo sapiens
ccgcccctcccgcaacgctcgaccccaggattcccccggctcgcctgcccgccatg

SEQ ID NO: 435 - DNA, 170 bp, Homo sapiens
ccctcttctttagactgccacgaggaaaaagcagatgtgagaactcaaggttcagggctgctcttctaagaaacaagtctgccataatctccatctgtgttggaatctgttaactaatgaactggtctctgtgcaaatcctgagtgctaaagcttccaacaagactgatg

SEQ ID NO: 436 - DNA, 96 bp, Homo sapiens
cgctctcttacactcgggcctcagaagtccgtgccagtgaccggaggcggcggcggcgagcggttccttgtgggctagaagaatcctgcaaaaatg

SEQ ID NO: 437 - DNA, 517 bp, Homo sapiens
agtccttctcattccttgcccccgcccaaggctctcttcaccttccccgcgggggtcctctcgttttctgtctcccaaatgctggcttcccgcctttcctcccccgcttatttacttaattaaggccctggggctgcaccccaccggcagctccttcgggggtgtggccgaagagctccgagggcggggctgaccgagccatattcgggcgtggccggtggtgattggtgagggcggggcctgccgcagggggcggggcctgcaggtttggcccccgcagggagcgcagctggcgccgctgggagctggtggcgcggcgcaggtcccggccgagtgtggcgcagcagtggcggcgcttcccattcgccatgcgccgggggtgggtgcccgaaggttgcatgatggaatttgaacattacttcaagaggttttgtattttggattagttaattgggtttgtcctctgctgactgtttcttcggatgcattttttggtgtgctcttgagggattaaatg

SEQ ID NO: 438 - DNA, 203 bp, Homo sapiens
cgtccttccggctctcggctttgccacaaagcttcccgaagacgcggccgctacccggagacgcggtcgccacccagaagcgctctcccgggaagccccgctcgtgggaccgcgccacctgcgccgcctctgcggcccgcagcccgacgggcgccgccatgttggggtcctagcgagggacgcgtaggtgtcttcataagatg

SEQ ID NO: 439 - DNA, 444 bp, Homo sapiens
cagtccttttgcaagagctgctaagagcgctgggtaaggagaggaaggggagagacatggaacttggctggtctgcagggaaatgccactgttttggccgggagtagggggcgggagtggcgggagagggggtggccggctggggaggagccagcctggtggagaagctgccctgtgggcgggggtgaggaggggagggctgtggtcaccaggcaggaaggaggggtggcctgacccctcggcagtccctcccctcagcctttccccaaattgctacttctctggggctccaggtcctgcttgtgctcagctccagctcactggctggccaccgagacttctggacaggaaactgcaccatcctcttctcccagcaagggggctccagagactgcccacccaggaagtctggtggcctggggatttggtgggtctgctccttag

SEQ ID NO: 440 - DNA, 656 bp, Homo sapiens
cctcctttctccttccctcttgcctccagtgactgtctccaggatttctctcttcctatttcaggaggactctcacaggctcccacagcctgtgttaagctgaggtttcccctagatctcgtatatccccaacacatacctccacgcacacacatccccaagaacctcgagctcacaccaacagacacacgcgcgcatacacactcgctctcgcttgtccatctccctcccgggggagccggcgcgcgctcccacctttgccgcacactccggcgagccgagcccgcagcgctccaggattctgcggctcggaactcggattgcagctctgaacccccatggtggttttttaaacacttcttttccttctcttcctcgttttgattgcaccgtttccatctgggggctagaggagcaaggcagcagccttcccagccagcccttgttggcttgccatcgtccatctggcttataaaagtttgctgagcgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatttgtatgttgcaccatg

SEQ ID NO: 441 - DNA, 80 bp, Homo sapiens
cggccttctgggcgcgcgcgacgtcagtttgagttctgtgttctccccgcccgtgtcccgcccgacccgcgcccgcgatg

SEQ ID NO: 442 - DNA, 36 bp, Homo sapiens
agttccttccccagaaggagagattcctctgccatg

SEQ ID NO: 443 - DNA, 309 bp, Homo sapiens
ggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatg

SEQ ID NO: 444 - DNA, 121 bp, Homo sapiens
cggccttccatcccagtttcttctaggaattcggagcctcccctgcagcgactcggaagattcgaggcggcgggggacaagtcggcgccccagagcggacgagtcaccaggtgtcaagatg

SEQ ID NO: 445 - DNA, 54 bp, Homo sapiens
ccgcctttctccgctggcaacggcgccgctccccgctcctcctccccagccatg

SEQ ID NO: 446 - DNA, 49 bp, Homo sapiens
ctcccttcccttgcatgctgcattgtgtcgggagttgctgacagccatg

SEQ ID NO: 447 - DNA, 210 bp, Homo sapiens
ccgccttcctagtggagacgcgagtgggggaggagcagtccgaggggaacgtgggttgaacgttgcaactagggtggagatcaagctggaacaggagttccgatcgacccggtaccaagaaggggagtgcccgcggcagggttcattgaaaaaatccttagtgatattgacatgtctcaagtgacataaattagccaatgactcggaatg

SEQ ID NO: 448 - DNA, 63 bp, Homo sapiens
tggcctttgtcaagtcatcccctcttctcctcaggaactgctcaaacctgtgccccaaagatg

SEQ ID NO: 449 - DNA, 17 bp, Homo sapiens
ggatctctttcgccatg

SEQ ID NO: 450 - DNA, 104 bp, Homo sapiens
ctgtctccctcggcctgtgccgccgccgacgccgcttgtgggcccgactccgctctgtctgcttcgccaccttctccccgagcactgcccggccggccgccatg

SEQ ID NO: 451 - DNA, 134 bp, Homo sapiens
catcctctcttccaccctctcttctccctggtcaaccgctctgcaaacaaccatcaatctgatcccacaggcctgagaaagtctgctctccagtacctgctgctgatctgtttcagccgacaagaggcaccatg

SEQ ID NO: 452 - DNA, 47 bp, Homo sapiens
ctgcctttcgatctctccacatctcggtggcgcgggatctcaagatg

SEQ ID NO: 453 - DNA, 76 bp, Homo sapiens
aatcctttctcctgccgcagtggagaggagcggccggagcgagacacttcgccgaggcacagcagccggcaggatg

SEQ ID NO: 454 - DNA, 118 bp, Homo sapiens
gagccttttctcgctaacaccgctcgccctctccgagtcagttccgcggtagaggtgacctgactctctgaggctcattttgcagttgttgaaattgtccccgcagttttcaatcatg

SEQ ID NO: 455 - DNA, 132 bp, Homo sapiens
gtttctctatcagtcgcgcagctgtgttcgcggactcaggtggaaggaatttcttctcttcgttgacgttgctggtgttcactgtttggaattagtcaagtttcgggaatcaccgtcgctgccatcaacatg

SEQ ID NO: 456 - DNA, 72 bp, Homo sapiens
ggttctctctctccagaaggttctgccggttcccccagctctgggtacccggctctgcatcgcgtcgccatg

SEQ ID NO: 457 - DNA, 56 bp, Homo sapiens
caacctctcctcttcgtctccgccatcagctcggcagtcgcgaagcagcaaccatg

SEQ ID NO: 458 - DNA, 34 bp, Homo sapiens
ctttctcccgaacgccagcgctgaggacacgatg

SEQ ID NO: 459 - DNA, 32 bp, Homo sapiens
ctctctctgcaccttccttctgtcaatagatg

SEQ ID NO: 460 - DNA, 141 bp, Homo sapiens
cggcctccatgtgcgacgtgttctccttctgcgtgggcgtggcgggccgcgcgcgggtctccgtggaagtccgtttcgtgagcagcgccaaggtgaggtcggggcgggtcctgccgggagcctctccccagtccggccatg

SEQ ID NO: 461 - DNA, 84 bp, Homo sapiens
ctgcctttttacagctagacctgtgtgctgcaaggagctaaggccttcagtgtccccttccttacccaggtttctcacagaatg

SEQ ID NO: 462 - DNA, 493 bp, Homo sapiens
ccgccccttgcaccgcccacgtggccagcgccacctgcctcattgtgcccaggagttctccaaacccgcgctgcggagtgagtgaccaagttccggccagttcgacctcgaggatccagaggtggagacggtactacctcccagctctgttttccatccccttcaggtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaaggtttcaagtgatcctcccgcctcagcctgcccaggtgctgagattacatgtatgagccactgcacctggaaaggagccagaaatgtgaagtgctagctgaaggatgagcagcagctagccaggcaaagggggcaatg

SEQ ID NO: 463 - DNA, 275 bp, Homo sapiens
tgttcttcccccacctgccacgtacagagcccaagttctcgctaggcttgttgggtcagcgcgattggccggggcccgcgcgagcctgcgagcgaggtgcggcggtcgcgaagggcaaccgagggggccgtgaccaccgcctccccgcgacgccccagtccagtggcctcgcgtccgcccattcagcggagacctgcggagaggcggcggccgcggcctccgcaagccgtctttctctagagttgtatatatagaacatcctggagtccaccatg

SEQ ID NO: 464 - DNA, 133 bp, Homo sapiens
catccttctcaaaagacttattgacagtgccaaagctcggtactggacacaacgagggacctgggtctacgataacgcgcttttgctcctcctgaagtgtctttggtccaacgttgttccagagtgtaccatg

SEQ ID NO: 465 - DNA, 117 bp, Homo sapiens
ttttctctctctctttcactgcaaggcggcggcaggagaggttgtggtgctagtttctctaagccatccagtgccatcctcgtcgctgcagcgacacacgctctcgccgccgccatg

SEQ ID NO: 466 - DNA, 79 bp, Homo sapiens
caccctctcggggagggagttggggaagctgggttggctgggttggtagctcctacctactgtgtggcaagaaggtatg

SEQ ID NO: 467 - DNA, 96 bp, Homo sapiens
tctccttcctgcgcgcgcgcctgaagtcggcgtgggcgtttgaggaagctgggatacagcatttaatgaaaaatttatgcttaagaagtaaaaatg

SEQ ID NO: 468 - DNA, 165 bp, Homo sapiens
cagtctttcctgctaagcctcagcgtctcctccaagccacatcaaaatctttccttctgggcctttcccagaagtgaattcttgctggaaggtataaaagaccagctcctccaagcagagcaactccctggctgccgtgaaaagacaaggcactgggcagtgatg

SEQ ID NO: 469 - DNA, 49 bp, Homo sapiens
ctgcctttacaacagagggagacgatggactgagctgatccgcaccatg

SEQ ID NO: 470 - DNA, 36 bp, Homo sapiens
cgccctctgcggtgaaggagagaccacactgccatg

SEQ ID NO: 471 - DNA, 192 bp, Homo sapiens
aagcctctttcatcggggcacagacttccttttacttcttccttttgccctctcgcctcctcctcctgggaagaagcggaggcgccggcggtcggccgggatagcaacaggccgggccactgaggcggtgcggaaagtttctgtctgggagtgcggaactggggccgggttggtgtactgctcggagcaatg

SEQ ID NO: 472 - DNA, 531 bp, Homo sapiens
cgccctttattcttgctcggcctcgccacagagagcaaatcagattggctgggcgacaacctcaaagggcggggctgcacacgttcactacgggaatgaggtagcggtggagggggcagttgggcggggataggccgtcctagctaaggtggtaaaggccaataactcttcaggctgcctctcctcgaaaagtcatcttctcgcgaacctttaaaatgccttcctccccaagcacctcaagggactagaactgagtgcttcatttgtcttttttcctccttgcaaaagtcccgtttgccaccatggggatgtaccaagtgagaccgagtagggggaacgagtggtgattgacgcgccaggttactggccactgctcacctaggcgctagcaaacttctgccaagatcggaactgagtactaaacagcctccacagttctccctggtgccgtctccggcttggcgccgcatcctcctctgggctcgcgatggccgcgtcccctcccgctgcggacgggtcctttggtacatg

SEQ ID NO: 473 - DNA, 167 bp, Homo sapiens
ctgcctctttccggctgtgaccctcctcgccgccgccgcttggctgcgtcctccgactccccgcgccgccgagaccaggctcccgctccggttgcggccgcaccgccctccgcggccgccccctggggatccagcgagcgcggtcgtccttggtggaaggaaccatg

SEQ ID NO: 474 - DNA, 122 bp, Homo sapiens
aactcctttccccctgctgtgacgtacaggtgaggtaaacagtactgaagtccagggcgtcggtgctcactgctctggcaatgcccggtgagactgaattatgtttaaatttattgtagatg

SEQ ID NO: 475 - DNA, 62 bp, Homo sapiens
ggctccttcccagcccccggcctagctctgcgaacggtgactgcccatccttggccgcaatg

SEQ ID NO: 476 - DNA, 91 bp, Homo sapiens
gacccttttcccctccccgggccacccagcccgcccaactcccagcggagagcaaggttttcttctgttttcatagccagccagaacaatg

SEQ ID NO: 477 - DNA, 33 bp, Homo sapiens
ttttcttttcctctaggcagagaagaggcgatg

SEQ ID NO: 478 - DNA, 259 bp, Homo sapiens
ctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttagatg

SEQ ID NO: 479 - DNA, 22 bp, Homo sapiens
gcttctctttctggtcaaaatg

SEQ ID NO: 480 - DNA, 74 bp, Homo sapiens
ccgccttttgtgctgcggccgcggagcccccgagggcccagtgttcaccatcataccaggggccagaggcgatg

SEQ ID NO: 481 - DNA, 75 bp, Homo sapiens
tggtctcttcggtctcctgccgcccccgggaagcgcgctgcgctgccgaggcgagctaagcgcccgctcgccatg

SEQ ID NO: 482 - DNA, 192 bp, Homo sapiens
ccccctctccctccctccttgcgggccctcctccccttccctcccctccgcccccttccccgtaggcagcccgcccgccagtccgcccgcaccgcctccttcccagcccctagcgctccggctgggtctctcccccgccccccaggctcccccggtcgctctcctccggcggtcgcccgcgctcggtggatg

SEQ ID NO: 483 - DNA, 470 bp, Homo sapiens
tcgccttctgcccgggcgctcgcagccgagcgcggccggggaagggctctcctcccagcgccgagcactgggccctggcagacgccccaagattgttgtgaggagtctagccagttggtgagcgctgtaatctgaaccagctgtgtccagactgaggccccatttgcattgtttaacatacttagaaaatgaagtgttcatttttaacattcctcctccaattggtttaatgctgaattactgaagagggctaagcaaaaccaggtgcttgcgctgagggctctgcagtggctgggaggaccccggcgctctccccgtgtcctctccacgactcgctcggcccctctggaataaaacacccgcgagccccgagggcccagaggaggccgacgtgcccgagctcctccgggggtcccgcccgcgagctttcttctcgccttcgcatctcctcctcgcgcgtcttggacatg

SEQ ID NO: 484 - DNA, 42 bp, Homo sapiens
cgctcttccttccgcttgcgctgtgagctgaggcggtgtatg

SEQ ID NO: 485 - DNA, 193 bp, Homo sapiens
tcgtcttctctgtcttagggctggtgctggccctgcccacgcctagggctccggcgcgtcacgggcctcagctgggattcccgcgcccctcggacggccacgagactcggacatctttccaggaacagcgtgaggaggacagaagcacccaacaggactgctcaagccacctgcgaacactgctgctaccatg

SEQ ID NO: 486 - DNA, 66 bp, Homo sapiens
agttcccttttccggtcggcgtggtcttgcgagtggagtgtccgctgtgcccgggcctgcaccatg

SEQ ID NO: 487 - DNA, 36 bp, Homo sapiens
cctcctcttgacgtggcagaggcggcgccagccatg

SEQ ID NO: 488 - DNA, 77 bp, Homo sapiens
cgtcctctttcctttccttctccctccccttttcccttccttcgtcccttccttccttcctttcgccgggcgcgatg

SEQ ID NO: 489 - DNA, 110 bp, Homo sapiens
ccgcccctcccgctggatcccgcagccgcggctcttcccgacgcgttccgccttccccagctgtgcactctccatccagctgtgcgctctcgtcgggagtcccagccatg

SEQ ID NO: 490 - DNA, 125 bp, Homo sapiens
gcttctctttcctttcgcgccggttgccgctgcggagcgcggcgggtccatgtgcgcagtgagtggcgctattcctggcccagtagcacccgagccccgggtttgaccgagtccgcgctgcgatg

SEQ ID NO: 491 - DNA, 625 bp, Homo sapiens
gctcctttgcgcacgcgcgccgcttcccagtggcaagcgcgggcaggaccgcgttgcgtcatcggggcgcgcgcctcagagagagctgtggttgccggaagttgagcggcggtaagtgagccgcggcgggcgagggtgtagtggggtcttgctgggccggttttggaggcctggagtcaaggggcgagctcgccagggagggcgagggtcacagcaagtctcaggatcctcctctgccagtttctgggtggtccttcctcctccagggactcactgattccggctggcgcccttcgtctgtagccgcgtcccctcagactggttcagtccggggtcttctgacttggaagctcgtgctgatttcctaagtcagcccctcctgtcctcttggtaggcagtgctcagaatcttcagtgttggaacacgggagatgggacatttggattcccagcctggctgtgtctggatttgctgtctctggcacgttccttccccatctaagctgcttttccatctgcaaaatgggaatgataatccgccatttgtttaagtgaggaggttaaataagtttactttctgagaaagaagattctcgattccttggttacagggttagaaactaatg

SEQ ID NO: 492 - DNA, 115 bp, Homo sapiens
cgctccctttgccgccgccttagcccgggacccgaacccagcctctcccctacccgaacaccggccccggctccaccgaggcccgggtcccccagcccgtctcgccgccgccatg

SEQ ID NO: 493 - DNA, 224 bp, Homo sapiens
agcccccttttccctccatggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatg

SEQ ID NO: 494 - DNA, 86 bp, Homo sapiens
acttctcttttccctagactgcagccagcggagcccgcagccggcccgagccaggaacccaggtccggagcctcaacttcaggatg

SEQ ID NO: 495 - DNA, 145 bp, Homo sapiens
cgctccctctgggcttccgtcctccgcccgcgcccgacggagcctgttcgcgtcgactgcccagagtccgcgaatcctccgctccgagcccgtccggactcccccgatcccagctttctctcctttgaaaacactaagaataatg

SEQ ID NO: 496 - DNA, 159 bp, Homo sapiens
aggcccccttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatg

SEQ ID NO: 497 - DNA, 38 bp, Homo sapiens
gcttctttcccgagcttggaacttcgttatccgcgatg

SEQ ID NO: 498 - DNA, 69 bp, Homo sapiens
acccctcttttctagagttctgcctcgcttcccggcgcggtcgcagccctcagcccacttaggataatg

SEQ ID NO: 499 - DNA, 55 bp, Homo sapiens
ctcccttctgcctgggacgtcagcggacggggcgctcgcgggccggggctgtatg

SEQ ID NO: 500 - DNA, 1300 bp, Homo sapiens
aagccctttccgaggatggcaaaggatctgggaatgcttctccaaagatatgtggatggacgaaataggtctctggtgatactgaggcggggtggggacggggaggcaaagacttggcttcttaggaattggaagaaataagtaaacaatgtttggtagcaatttgtaataaggaagtaatcataaaattaactacgtccgtttctgattgtgtcaactttgtcaaggagtagaagtttaagaattgaatactgtcctgcaaacaacgtaacctcatctcctgtttgacacaccctgttgagaagcagtcctttacctcctaaatttctttttcgaaattatcatttcctttatggactgagaataacactgcctgttcactcccaccgagctgtgaacagtgaccttaattcttccaagcagggaagtgtagaaactaaggtctgtgacagaccgcaaaatcatctcccaatctttaaggaaaatcagaatcacgcataatcccatagagataaatttgatgcatagtcttttcctatgcatacatttttcctttttttttacaataattgaatttttatattttttcagcttgcttctgtcacttaatatattatgagtaattttttttggttttttttgttttggagacagaatctcgcactgtcgcccgggttggagtgcagtggcgcgatctcggctcactgcaacctctgcctcccggcttcaagcgattctcctgtctcagcctccctagtagctgggattacaggcacccgccaccacgcccagctaatttttttgtgtgtttttagtagagaaggggtttcactatattggccaggctggtctcaaactcctgacctcatgatacgcccacctcggtctcccaaagtgctaggattacaggcctgagccaccgcgccagcctattatgaataattttctacatgaatacgcatcgtactaaataactttaaatgttggtgtagtatgccattgtatgggtatggcatcatttattgttagacgttagattgtttccactaagtcggtattataaagagaactaatgacttcattattattagctttttctttctttggacacaatatccaaaaagaaattgttgtttcaaagatatgcaagatttttaaggctttttgatatgtattgtcaaattgccctccagaaagaatacatgaatttacactcagcagctctgcttccagcgtgaaagactttctattgtaccattttggtgttttttccctagctctcagactccccagtacaatg

SEQ ID NO: 501 - DNA, 539 bp, Homo sapiens
gtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttccgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatg

SEQ ID NO: 502 - DNA, 310 bp, Homo sapiens
acccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatg

SEQ ID NO: 503 - DNA, 104 bp, Homo sapiens
ttttcctttcttagccaaatcaccaaaatgtccagttagaacaagaatttagcattctgcaaaagaagttaacagctgagataacgaggaaatattctgaaatg

SEQ ID NO: 504 - DNA, 134 bp, Homo sapiens
ggttcttctgggcgctaagggagctgacggagagggccaccgcccagcaatagacggtgcctcagcctgccgagccgcagtttccgtggtgtgagtgagtccgggcccgtgtcccctctcccgccgccgccatg

SEQ ID NO: 505 - DNA, 296 bp, Homo sapiens
cggcccttcgcagcgggcgcgctgtcagacctcagtctggcggctgcattgctgggcgcgccgctctcgtctgatccctgctggggacggttgcccgggcaggatcctttacgatcccttctcggtttctccgtcgtcacagggaataaatctcgctcgaaactcactggaccgctcctagaaaggcgaaaagatattcaggagcccttccattttccttccagtaggcaccgaacccagcattttcggcaaccgctgctggcagttttgccaggtgtttgttaccttgaaaaatg

SEQ ID NO: 506 - DNA, 231 bp, Homo sapiens
cgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatg

SEQ ID NO: 507 - DNA, 152 bp, Homo sapiens
gggtctttgtctcgctgcagcgggtgctgcaggtctggccttcacttttctgcgtcctcttactcctagaggcccagcctctgtggcgctgtgatctggttattgggagattcacagctaagacgccaggatcccccggaagcctagaaatg

SEQ ID NO: 508 - DNA, 150 bp, Homo sapiens
ctttctttgacgcaagggctcgagacgcagccgccgtcggccgagcgcccggctagaagcgacaccagacggagcctccggagttcctccgcccccacctcgccgggtcctggagccgcagtcctcccagctgccctcctcgtggccatg

SEQ ID NO: 509 - DNA, 608 bp, Homo sapiens
ctgtcttttctccagtttgagcgggggtgtcgggagcaggcggagagctttcctgcgaggctgtggaagcagtgaacactcttctcagcggctcgcctcccagcagtgctattttttgccatccgccctcacccccagcacacgcgctcgcacacacacgcacgcacgcacacacacacacacacacactcacacagagacctctctgggtttctttgccttgagtctcccggggctgtgagaagccaggcgcatctcaaaccgagctggcagctccaggctccggagccatgccctgcacggaccctcgtctttaccacgctcctgaggaatgaaaggaacccagggaccctcagaaggcagcagtgatgcggaccaaccccccggagcctgcacccttccgagggccataggcgacccagggaactggagagagctccagaaaggaaatcccagctttcccaaagtccctgtggatgctgacaaaaggagacctgaatttttggaagagcctgtactaggttacccggctgcagagtgattttcccctccggcactgactctccccctccaacccccagccgtccagagtaccatgaagaattatg

SEQ ID NO: 510 - DNA, 32 bp, Homo sapiens
ttccctctccgctgcgtccccgcgcgaagatg

SEQ ID NO: 511 - DNA, 56 bp, Homo sapiens
cttcctccgcggtcttccgagcggtcgcgtgaactgcttcctgcaggctggccatg

SEQ ID NO: 512 - DNA, 197 bp, Homo sapiens
cgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatg

SEQ ID NO: 513 - DNA, 1250 bp, Homo sapiens
ttttcttcctggtggcgtttgggcttaatacagctttggcgaggtcggatgacgggtgggagccagcggtggaaggggtggcgaaagtaccggtttgccccaggccgccgaggggcctccttagagagaccttgcctgctccgctcgcgtccgccggggccgcgcgggtcctcctggcgccgccaggttcaaaaagccactcgagttgtcactgcgacggccctgggccaggagccgtttcgggatctgtcaaacaacgagttttcgtcgttcgaatcaggttgactggtccttcatccccccaatctcccgtacctggcgagtccagctcgtcgcggcaatgctaagaaaagagtgatatgcaagctgagaccaaaaatatggtatgatttagccatactgaaggggaaggaaataagagctgggcaaagcattctgtgaattggctgactccacttctatggtgagagagaggagtgcatcaaagattactcccagtagagatggtttcagcatgttggccagtctggtctcagactcctgacctcaagtgatccacccacctcggcctcccaaaatgctgggattacaggtataagccactgtgcctggccaaagataccgttaaccctggataaagagaatggaggttacctctgtccgtgtagattcctaagctgtcctggagtgatccttggagtaaaggaaaggtgctttgaagcacattcagccatcagccctgtgggatggcagccactgatttgtcctatggtctttacagggacccagtctgccttcaagaaaagacagaagtagaaagggtggtggctgactgtctgacaaattgttatcaggtatgcaggaagtatatccttctccaaaatatcatacttgcatcaccaggtagacacatttccttctacacagaattatcttcagagcttcttaaagcaaataaagcctgcttcaaggactgagtccctagtcgaattcccggaaggagtggagcctgtcatattgtgtttatctagcatctgctcaagagtgtgctgcagtggagggaaatcagatgacctcccagtctggttgtgttacatacaatcatgtgtaagaagtgccattcaagccgtgtcactggaggggactgacagtgagattcagtgacttttgatgatctggctgtggacttcaccccagaagaatggactttactggacccaactcagagaaacctctacagagatgtgatg

SEQ ID NO: 514 - DNA, 36 bp, Homo sapiens
gcttccctcccggcgcagtcaccggcgcggtctatg

SEQ ID NO: 515 - DNA, 182 bp, Homo sapiens
cttcctttctcgtgttgttatcgggtagctgcctgctcagaacccacaaagcctgcccctcatcccaggcagagagcaacccagctctttccccagacactgagagctggtggtgcctgctgtcccagggagagttgcatcgccctccacagagcaggcttgcatctgactgacccaccatg

SEQ ID NO: 516 - DNA, 336 bp, Homo sapiens
cctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatg

SEQ ID NO: 517 - DNA, 857 bp, Homo sapiens
tggtcctttcttttatgattcacaaggaatgaccctcttcatcgcctctcctaattcagtcctcacaacagtccttttacaaatgggacaacaggttagaggaagtcaggcagatttccagcatcatagagagtaaaggaccagggaaggatcaggattcaaggactgcacccaggctctgcttccagcttgctgtgtgactttgggtaattttgttcccttagggaactgagctttctcatttgtaaatgcaaacaggctgttgggaggatcaaatgagatccaggggtgaaaacagcttagtttactttcaggaatttacccacgcggtatataaaggcaaaatattattatagtcaggtgattgtagattgaggaacccatttcctcattctgcaaattgcaaacctgagggcccaaagagggacaggggcttgccccaggtctcagcaggctgtgagcaagagctaaagcctaatcctcctgcctttgggcctggagcccttccttgtaccccaggggtcagtgtctttgttggatacaggcttagattgactgactgtaccctgagaacctaggggagtccctgttcccaattcttctcctacccccaccttggcctgatggaggaagaccctgctgtgttgagatgagcaccagagccaagaagctgaggaggatctggagaattctggaggaagaggagagtgttgctggagctgtacagaccctgcttctcaggtcccaggaaggtggcgtcagcatctgcagccgcgtcgacgttgtcggagcctccgcggaggacccaggagagccggactaggaccagggccctgggcctccccacactccccatg

SEQ ID NO: 518 - DNA, 54 bp, Homo sapiens
ctttccttcggcttccgttcttggtccatgtgagagaagctggctgctgaaatg

SEQ ID NO: 519 - DNA, 67 bp, Homo sapiens
ggttctctgtcagtcgcgagcgaacgaccaagagggtgttcgactgctagagccgagcgaagcgatg

SEQ ID NO: 520 - DNA, 96 bp, Homo sapiens
ccgcctcttgtttttcccgcgaaactcggcggctgagcgtggaggttcttgtctcccctggtttgtgaagtgcggaaaaccagaggcgcagtcatg

SEQ ID NO: 521 - DNA, 114 bp, Homo sapiens
tactctttatcaatcgtcttccggcgcagccccgtccctgttttttgtgctcctccgagctcgctgttcgtccgggttttttacgttttaatttccaggacttgaactgccatg

SEQ ID NO: 522 - DNA, 219 bp, Homo sapiens
ctccccctctcgctctcctccctcttcccggctccagctccgccgccagctccagcctttgctccccctcccaaagtcccctccccggagcggagcgcacctagggtccctcttccgtccccccagcccagctacccgttcagaccagcagcctcggggggcacccccccgccagcctgcctccctcccgctcagccctgccagggttccccagccatg

SEQ ID NO: 523 - DNA, 146 bp, Homo sapiens
agatcttcttccgctctgaggcgctactgaggccgcggagccggactgcggttggggcgggaagagccggggccgtggctgacatggagcagccctgctgctgaggccgcgccctccccgccctgaggtgggggcccaccaggatg

SEQ ID NO: 524 - DNA, 304 bp, Homo sapiens
cggcctctttgtgtggtgcccagataggggagcggaggtggcggcggcggcggtagcggtggccttggttgtcttccagtctcctcggctcgccctttagccggcaccgctccccttccctcccccttcctctcttccttccttccctccccttccctttttcccttccccgtcggtgagcggcgggggtggctccagcaacggctgggcccaagctgtgtagaggccttaaccaacgataacggcggcgacggcgaaacctcggagctcgcagggcgggggcaaggcccgggccttggagatg

SEQ ID NO: 525 - DNA, 737 bp, Homo sapiens
ggctcttttgttcggctgaggggagggccgttggccggggcctgcggtacgccgcttcagtgagggacgccactgcggccacccggcttgctgccttcctgggcgccactcccccaggcgacccgacgcgacgcgccagcagcgcagcaccgattcctctcgggctcttgggcgctgctctgaggtgaggagcccgctggaggcgggagagctgggggagggggcgcggcggcggcggcggcgggagccctgcgtgagggaacgcgctttcgaggcggaggttaggagcggggagcgcgcccgggtccagcgtcctgcttctccgcttcccgcgctgagctcttcgcctgtcgctgaggcgtcggtgccagctgcgtgaaggatggagagggcggggcgcgaatcctgagccagagactgagtgcttgggggtgggccgagcacttgggggccgctcttcggggcccgggtggtctggaacaatgttgcttggctgggcggctgcgggatagggcggaaggggacaggcttgaggcttggataggcgtgaggaggcgcatacgaccgcacaacccgaggtttgtaactgtattcggaagacgccgggtccggctgggactgccagaggaacctggctttgcaggactacggaggagtaacgtcgagtgaattggaagagggcccagggccgcacaagcagcgtcaccctttacaccagaaagctggcgggcactatg

SEQ ID NO: 526 - DNA, 204 bp, Homo sapiens
cgcccttcttaggaggggctgcattgcagggggagagtgaactgacagactcagtcactgaagagggaaaaggagtgagaagacaaagccgtcaaagccccaacagctttgtatttctccagcccggcgcagaccccggagctcccgaggcactccctccatctttggaacacgccagtaattgattgataacaggaagctatg

SEQ ID NO: 527 - DNA, 145 bp, Homo sapiens
ttttctttctttcctagagtctctgaagccacagatctcttaagaactttctgtctccaaaccgtggctgctcgataaatcagacagaacagttaatcctcaatttaagcctgatctaacccctagaaacagatatagaacaatg

SEQ ID NO: 528 - DNA, 592 bp, Homo sapiens
acttcttcctcccttcccctctcttcccctccctccccagccttccccgcgagcggacgcggcagcgcctctgtctcgctttttcttatttttcccccctttcccctttctttttttttttttcttttcttttctcccctccccccctttcaccatttcccctcggaggcgctttccccgggcaggggcagagccggtctcaccccccgcctctccccggcccccgccgccctatggcgagagggagccccctcccaacccgggctcgagcggcggcggcctcaggccgggggtcatcatggaactaattcgctgaccgacccagcggccgcagccgtgcgtcccgctcgagcgccagcgcccgcgcccgcgccccccgatccgcttcccctttctccctcctcagttggccgagtcgtcccgcgcgcaccgcctccgcgcgcctatgagaatgaggtggtaacgggcccccggatgaccccgcgtcaccactgtgaggcctacagctctgccggggaggaggaggaggaggaagaggaggagaaggtagctacagcaagctgggtagcaggcagatccaaaggatatcatg

SEQ ID NO: 529 - DNA, 29 bp, Homo sapiens
cattccctcgcgctctctcgggcaacatg

SEQ ID NO: 530 - DNA, 71 bp, Homo sapiens
gtctctttgtcctgccggcactgaggactcatccatctgcacagctggggcccctgggaggagacgccatg

SEQ ID NO: 531 - DNA, 97 bp, Homo sapiens
gggtctctcggtcccgcagccgtgaggaggacggtctgcatactcgctgcccgccggctccctcccccgcgtccctgcgaccgccgcggcgaagatg

SEQ ID NO: 532 - DNA, 130 bp, Homo sapiens
gggcccttttcgcggccgggccccagcatggctgcccccacggctgagggcctggcagctgctgcgccctcgctttcttgacattccctggcttctgtgctctcttccccaggccaccccagcagacatg

SEQ ID NO: 533 - DNA, 26 bp, Homo sapiens
ctgtctttctcagaaaaccaaatatg

SEQ ID NO: 534 - DNA, 400 bp, Homo sapiens
gtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggaaacaagaatctcagtgtaacccgagcaaaatcgcgcgtctcagcgttgcttgtatagagctgtaggtaaaacttgcctactgatcagttacacaaccaatgcatttcctggagaatatatccctactgtctttgacaattattctgccaatgttatg

SEQ ID NO: 535 - DNA, 17 bp, Homo sapiens
tcgtctcctccaagatg

SEQ ID NO: 536 - DNA, 152 bp, Homo sapiens
ccgcctttccttttgtttgtctcacgttttgcgtgggaggcggtcccgggatttcaggggtctaccggctctcttatggcgaatgcaacccgaagagagagtgagctgtatcttcagagttgtctccgtctttccaagaacagaacaaaatg

SEQ ID NO: 537 - DNA, 40 bp, Homo sapiens
gcctcctttccaagcgcgacccgttgaggtccttgtcatg

SEQ ID NO: 538 - DNA, 152 bp, Homo sapiens
ccgcctttccttttgtttttctcaggttttgcgtgggaggcggtcccgggatttcaagggtctacgcgcttttctatggcgaatgcaacccgacgagggagtgggctgtatcttcagagttgtctccgtctttccaagaacagaacaaaatg

SEQ ID NO: 539 - DNA, 235 bp, Homo sapiens
ctttctttttcctttcttcggaatgagagactcaaccataatagaaagaatggagaactattaaccaccattcttcagtgggctgtgattttcagaggggaatactaagaaatggttttccatactggaacccaaaggtaaagacactcaaggacagacatttttggcagagctgctcactccttgctcagctcagttttctgtgcttggaccctctgggcccatcctggccatg

SEQ ID NO: 540 - DNA, 131 bp, Homo sapiens
ctctttgggatgctttgttgtctggtggtgactgtgcccatgggtgagttgtatcggaaaatcgtcatgtgaggatcagaggggaaaagaaaacagaggcctctggtctctgcctgccctgggtgctcatg

SEQ ID NO: 541 - DNA, 137 bp, Homo sapiens
acgcctcctcttgcgctgtcctgttaatggcgggcagtagccgctgaggggattgcagataaccgcttcccgcacggggaaagtctaccctgcctgccactttctgctcgccgtcagcgccggagctcgccagcatg

SEQ ID NO: 542 - DNA, 130 bp, Homo sapiens
tgctctttctctagcacggtcccactctgcagactcagtgccttattcagtcttctctctcgctctctccgctgctgtagccggaccctttgccttcgccactgctcagcgtctgcacatccctacaatg

SEQ ID NO: 543 - DNA, 323 bp, Homo sapiens
caccctcttccgccgctcccgcccagcgacctcgctcccggggcgacgccccgcgtgcgccagagtcgccgaggtcgtccccggcaccggaagtgaccctggcgggtttgtcttcaaattctcggcgagcaggagccgcgccggcaggtggtgttgacgattgaactgggcagtactggggccgtgagcggagagcaaagtgggctggactgggtcaggccctccttcctcgctgccgggatctccactccgccaatcccctgtgcctggcgttgggcggtttcccgaggagcttgggccgccgcagcttacagttgaacatg

SEQ ID NO: 544 - DNA, 186 bp, Homo sapiens
ctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatg

SEQ ID NO: 545 - DNA, 100 bp, Homo sapiens
cggcctttcatttccgcttccggtgcgggccgcgcgcgagcgcagcggtgggaggcggcgaccagccggttgaggccccaggcttggcctcaccacaatg

SEQ ID NO: 546 - DNA, 126 bp, Homo sapiens
ctccctcctggcgcttgtcctcctctcccagtcggcaccacagcggtggctgccgggcgtggtgtcggtgggtcggttggtttttgtctcaccgttggtgtccgtgccgttcagttgcccgccatg

SEQ ID NO: 547 - DNA, 80 bp, Homo sapiens
gcgtctctatcgcgccagttcctcagcctcagtgctatgaaggtgacagcgtgaggtgacccatctggcccgccgcgatg

SEQ ID NO: 548 - DNA, 63 bp, Homo sapiens
gggcctttgcccgccttggcggccggctctacgttccctgttctcgcctgcagctccgccatg

SEQ ID NO: 549 - DNA, 309 bp, Homo sapiens
gcttcccttccgatgattcggctcttctcggctcagtctcagcgaagcgtctgcgaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatg

SEQ ID NO: 550 - DNA, 133 bp, Homo sapiens
gggcctttgtcccgacagagctccacttcctgtccccgcggctctgtgtcccctgctagccgtaggtcgtgtgacccgcaggcaccgggagatccagaagtgaaacgccaggctctctggaggccaggagatg

SEQ ID NO: 551 - DNA, 405 bp, Homo sapiens
cagtctttcgcggcccgggagctcagcagagctaccagctgccctgttggcttcgctggtcggatcgtcctcctggccccgccaaacaggcggggggagcggccccgactgtggggccatggcagtagtctcctcgttcgccgccgccgctagcctagctgagtcgccggcttctgcgctaggggctcccaccgcctccgcaggctaaggagccgctgccaccaacgagctgtgagggttactatgctccctctttgccgccgtctcctcctcttgcccgcgcaggcacccctctggctgctcagtcctgcctcagtgtcaaaccagaagagaagtaaaattcaacaaaaatttatgtgtggagttccttcttaaaagaagaaaaaagtgattatttagactatg

SEQ ID NO: 552 - DNA, 196 bp, Homo sapiens
agccctccttgctagtctgggacttcccggtggagtgaggaacccagcaacacgctcctgacttcccttcccaaggactcgacctgagaaggacacagcagtctctgaatttcatgctctcctctttgatgtgaagaaaatgaaaagctgaacagttgtggaactgtggatagagttagacaataaggccgccatg

SEQ ID NO: 553 - DNA, 238 bp, Homo sapiens
ccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatg

SEQ ID NO: 554 - DNA, 166 bp, Homo sapiens
ctttctttccgtcgcagagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatg

SEQ ID NO: 555 - DNA, 576 bp, Homo sapiens
ctcccttccccctccgcccccggacggccgctggggcgcgcgcctctcctcgcacccccaccctgagtccccacactccgcggggccaccgagctgctgaggcccctttgcgggcccgccgagcggttccgggtttagggttcacaggtcagagttgactccctgaaaagtgcagccggtttgaaatgcaagatggcggcggcgtggcgctgagaggcgcggcggcccctgcaggagaagacagactgctgctttggacctgttggtaatgatggcctgagctaaacatctaactagaagggatacccttccatttcaaagaacagaatgctaaggaagctgtggcaagtgattggagttgtgcttcaaaaatttcagaaattcagcagtattttatctgccaacaataagctctttacttgattgcaccatgagaaagctgctaatgagacttgttgagcacaaaaatggacttgaagaaccaaaagccattgttttcaaatgaagaacactgaacagttttaagcctcgatgctttttaatcaccactgagcttttcctcataacatcagaatg

SEQ ID NO: 556 - DNA, 81 bp, Homo sapiens
ccttccttccctccctccttccctcctgtcgccgtctcttctggcgccgctgctcccggaggagctcccggcacggcgatg

SEQ ID NO: 557 - DNA, 180 bp, Homo sapiens
ctttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatg

SEQ ID NO: 558 - DNA, 58 bp, Homo sapiens
gagcctctttggtagcaggaggctggaagaaaggacagaagtagctctggctgtgatg

SEQ ID NO: 559 - DNA, 132 bp, Homo sapiens
tgccctttctttcgccagccttacgggcccgaaccctcgtgtgaagggtgcagtacctaagccggagcggggtagaggcgggccggcacccccttctgacctccagtgccgccggcctcaagatcagacatg

SEQ ID NO: 560 - DNA, 334 bp, Homo sapiens
ctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatg

SEQ ID NO: 561 - DNA, 102 bp, Homo sapiens
agctctctcgagtcactccggcgcagtgttgggactgtctgggtatcggaaagcaagcctacgttgctcactattacgtataatccttttcttttcaagatg

SEQ ID NO: 562 - DNA, 16 bp, Homo sapiens
cgttctccgtaagatg

SEQ ID NO: 563 - DNA, 16 bp, Homo sapiens
gcttctctgcactatg

SEQ ID NO: 564 - DNA, 140 bp, Homo sapiens
cgctcttttctcgggacgggagaggccgtgtagcgtcgccgttactccgaggagataccagtcggtagaggagaagtcgaggttagagggaactgggaggcactttgctgtctgcaatcgaagttgagggtgcaaaaatg

SEQ ID NO: 565 - DNA, 85 bp, Homo sapiens
atttctttgttaagtcgttccctctacaaaggacttcctagtgggtgtgaaaggcagcggtggccacagaggcggcggagagatg

SEQ ID NO: 566 - DNA, 46 bp, Homo sapiens
cggtctccgccggttggggggaagtaattccggttgttgcaccatg

SEQ ID NO: 567 - DNA, 42 bp, Homo sapiens
cttcctcctcgcccccacccagacccagaaggcgccaccatg

SEQ ID NO: 568 - DNA, 81 bp, Homo sapiens
cttccttcctagtcgcggggagtctgagaaagcgcacctgttccgcgaccgtcacgcacccctcctccgcctgccgcgatg

SEQ ID NO: 569 - DNA, 50 bp, Homo sapiens
ggttctctgtcccggttcctggggttgcacagacagaccctgtaaacatg

SEQ ID NO: 570 - DNA, 292 bp, Homo sapiens
gggtccctcgctggctagtaggagagactggtgcttgccccgcccggtggactaactcgcttaattttaaataaaaagtcgaggacacggcggtcgttttcccgaagacatgggccctcccatgggccatttgctccctggaggccctcgcgtcttgctgagcccggggagttaggatgacgcgagcggtgagggagcccggaacgattccttcgcggaacaattgaggcgaggcctttgggagtactttgtgggacggaccctggcgggccctgccagacgcacagggatg

SEQ ID NO: 571 - DNA, 82 bp, Homo sapiens
ccgccttcccaagagcccctgcggccgggcgcgaaaatggcggcggcggcgacggccgggcgctcctgaagcagcagttatg

SEQ ID NO: 572 - DNA, 87 bp, Homo sapiens
cggccttcctgcagcctcttccgctcgccggctgcggcgcctgggacggttgcggtgggtctgggcgctgggaagtcgtccaagatg

SEQ ID NO: 573 - DNA, 128 bp, Homo sapiens
cggtctctggcggagtcggggaatcggatcaaggcgagaggatccggcagggaaggagcttcggggccgggggttgggccgcacatttacgtgcgcgaagcggagtggaccgggagctggtgacgatg

SEQ ID NO: 574 - DNA, 51 bp, Homo sapiens
tctcctctttctccaccacctcgggccccggtgtccccggccagcactatg

SEQ ID NO: 575 - DNA, 338 bp, Homo sapiens
tcttccttccgggtcgcgctaggccgggcttgcggcggttgtgccgcatctagagagtcggggagccgcccccgcacccaggccttctcgcgctgcctggtcgctggtgaagcccgcggcgcgcgcctctcccggaccctgcagggtaaaagaatgtcacatgtcagcatttgtacctgaagtcagcatgcaaagttcagggtacctggatgaatgccaacttttgcatttcccatgtgtatcctgtgaccattctatctgggaacatccttcaaagagttcatgcatcttactgaggacacctgaccttttgaagcttcataattcacatctagatg

SEQ ID NO: 576 - DNA, 248 bp, Homo sapiens
gctccttctagcatccttcatccttcaggtaccagccatccagacagtgcttgagctgcagaaactgagaccagacctctggcctggccctccccaggggcctcctttcgtatagtcactgcttctgcatcagatactttcagctgcaactccctactgggtggggcacccatttcaggcagaaggttttggtaccctccactgaccctacacccagggctgctactgccgcttgtggcttcaggatg

SEQ ID NO: 577 - DNA, 47 bp, Homo sapiens
aggccttttgttcctgtcccggaaagccggcgtcctgccgcgcgatg

SEQ ID NO: 578 - DNA, 232 bp, Homo sapiens
cctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatg

SEQ ID NO: 579 - DNA, 122 bp, Homo sapiens
gtttcctctgctctccgctctcgcccgctagctctcctcccttccgctcctgcttctctccgggtctcccgctccagctccagccccacccggccggtcccgcacggctccgggtagccatg

SEQ ID NO: 580 - DNA, 79 bp, Homo sapiens
tgccctctgccgctgctcccgtctctttggttacgctcgtcagccggtcggccgccgcctccagccgtgtgccgctatg

SEQ ID NO: 581 - DNA, 160 bp, Homo sapiens
ccgcctcttccttcccgttgtttaaggcagttggttgccctcctgtccgtcagaggtgcagtaccagaggtggcgtgctgccgatttcgcgtttgccttgctggatgattccgcttgtttgccggctgcgtgagtgcttagagcttttcggtggaagatg

SEQ ID NO: 582 - DNA, 34 bp, Homo sapiens
ggctctctaccggtgagggtttgcggggaagatg

SEQ ID NO: 583 - DNA, 159 bp, Homo sapiens
cagtctctgtgcgttgaagccggagaccgcggcggcctcagcgaggaccctccgccccggagccgccggccggagccgcagcctctgccgcagcgcccccgccacctgtcccctccccctccgcctccgccggagccgcctcgtgcactctggggtatg

SEQ ID NO: 584 - DNA, 216 bp, Homo sapiens
gtgcctttttccgccgcgcgccaccagaatgtccctgtcttgaggtctaatggcggacgccagtatgttggagttggtggtggcttaagttttgaagggaggtagcatccgttggatatccacaccatccttctcgctgcaggctttcttggactccgtactgttggtgtaaccaaggcctggaggtctgggtggctcaggtttcctgcagccatg

SEQ ID NO: 585 - DNA, 163 bp, Homo sapiens
ctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatg

SEQ ID NO: 586 - DNA, 702 bp, Homo sapiens
ttttcttttctgctttgcaggcccaggctcaaggcaaattataagtagggaaccaatttgagggaaagacatgtgaacagagttaaggtaccacgtcctgggagcgaccagcagccccacctgaagtccgcatgcaactctgacaagctcaggtgcttgttttaaggaaaggggctactagagtcttaccaacagcgagcccaggtgggagatgaaacaggtactccccaaaataggtcatccgagggaggaaaactgatggagagcacaatgtgctctgagcgtttttaatgtttttaagcttttaaatgatttcttcaaggccgagcagcagcagcaaaggtgtggcttaaaggattaagggggtttctgctgacacctagaatgaagttactctattactaatcaagccgagaggaggcccactatgcccccgtttatcatcctttcccagttcctttttgctggtcacaaaacgatgctcatcaatcccacctaaagcaggaggccaggagcccagcctcttgtagaaacagcgagggtataactgccctcccgttctgcccccaagacgaaggaggactctcggaagccaagaaaggtttaagaagtctttctggatagagagcagtgcccaggcaggaagcctttcgccggcagagcggggtccaaggacgagctggagaggacagaggcgcgatg

SEQ ID NO: 587 - DNA, 40 bp, Homo sapiens
attcctttccttcctagccttggtcgtcgccgccaccatg

SEQ ID NO: 588 - DNA, 88 bp, Homo sapiens
ccacctcttcctgttcccgtccttgaggacgccgtgccgggtcagtgttagcctccagccctggttgtggaaggcgacagaagtcatg

SEQ ID NO: 589 - DNA, 249 bp, Homo sapiens
ccccctcccccgcggcgccgtctcctcctcccgcctgaggcgagtctgggctcagcctagagctctccggcggcggcgcagcttcagggcagcgcgggctgcagcggcggcggcggttagggctgtgtagggcgaggcctcccccttcctcctcgccatcctactcctccctcctcgtcatcctcccccttcgtcctcctcgccttcctcctcctcgtcaggctcgacccagctgtgagcggcaagatg

SEQ ID NO: 590 - DNA, 326 bp, Homo sapiens
cttccttcctcacttcctctgcaggagggagcgagagtaaagctacgccctggcgcgcagtctccgcgtcacaggaacttcagcacccacagggcggacagcgctcccctctacctggagacttgactcccgcgcgccccaaccctgcttatcccttgaccgtcgagtgtcagagatcctgcagccgcccagtcccggcccctctcccgccccacacccaccctcctggctcttcctgtttttactcctccttttcattcataacaaaagctacagctccaggagcccagcgccgggctgtgacccaagccgagcgtggaagaatg

SEQ ID NO: 591 - DNA, 69 bp, Homo sapiens
cttccttccgtctcgctcggagtttccctctgcgttcgctccgcgctgctggaggctgtcgtcccaatg

SEQ ID NO: 592 - DNA, 321 bp, Homo sapiens
cctccttctgttgcttcccgtctcctcggcggctcccctcccccgcccggctctccgcgccccttctgggcggcggggcggcggagccgtcggcgtgcggccctccttgcgttcgtgcgtgcgcccgtggcccggcgcacgtcccgcgacaccgaggccgagcggggcagggggctgaccgccatgaccccccagagcccggcgtgagggggccgagatgcggtgacctgccagcacctgccgcagccttcgtccgggagtcgccccatctctccacgcatcggggccctgtgccccttgctgctgcagccgggcaccatg

SEQ ID NO: 593 - DNA, 116 bp, Homo sapiens
gtgtctctcggcggagctgctgtgcagtggaacgcgctgggccgcgggcagcgtcgcctcacgcggagcagagctgagctgaagcgggacccggagcccgagcagccgccgccatg

SEQ ID NO: 594 - DNA, 96 bp, Homo sapiens
cgttctctcctccttcctccccgcctccagctgccggcaggacctttctctcgctgccgctgggaccccgtgtcatcgcccaggccgagcacgatg

SEQ ID NO: 595 - DNA, 55 bp, Homo sapiens
aggcctctgtcccccaccccctttccccggtcccaggctctccttcggaaagatg

SEQ ID NO: 596 - DNA, 274 bp, Homo sapiens
cggcctttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccggctactccctcttgatgccctcccctttgcccctcactcaggatg

SEQ ID NO: 597 - DNA, 28 bp, Homo sapiens
tcatcttttccccagaggcgtcggaatg

SEQ ID NO: 598 - DNA, 444 bp, Homo sapiens
aattctctctctttggctccctccttccgcgcgagtctctggagaagccgcagcgcgagttgccgccgctgctgcccggggccgggtaagtgggcctcactcagagcccgaccctcttggccccggcttgcgtcgacccccgccgggcaccgagcctgcgccgcgcgcggcccgggcgtcggggccgcgcccgaccgggaaaggccgggaagccggttgggcccgatcctcctggcagctagaacgggccgggcgggggaggggggaaccgagcagagcttagggggtggggcctcggagccaggccatgtcggggctcctcaagaagagggccagtgggactgctggggtcgggctggaggggatctgattgggggaagcgtctggggactgcttggggcctgattgggggacgtcgcgaggatcggcttgccttgcgccatg

SEQ ID NO: 599 - DNA, 31 bp, Homo sapiens
gggcctttgctgtgtgggataaacagtaatg

SEQ ID NO: 600 - DNA, 81 bp, Homo sapiens
ctgtctcttcgccggttcccggccccgtggatcctacttctctgtcgcccgcggttcgccgccccgctcgccgccgcgatg

SEQ ID NO: 601 - DNA, 362 bp, Homo sapiens
cctccttttcctgcccccagactagaggcgggatgtagtctcttaggctaagagtgattggtcacaaggagactcggaagtgtctgatcagagccccagaggaggccttgagagcctgttggcgtaccgttccacacttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgagagaaatcccagatcctgtgatg

SEQ ID NO: 602 - DNA, 130 bp, Homo sapiens
catcctctaagcttttaaatattgcttcgatggtctgaatttttatttccagggaaaaagagagttttgtcccacagtcagcaggccactagtttattaacttccagtcaccttgatttttgctaaaatg

SEQ ID NO: 603 - DNA, 25 bp, Homo sapiens
gctcccctctcacgcagccaacatg

SEQ ID NO: 604 - DNA, 163 bp, Homo sapiens
catccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatg

SEQ ID NO: 605 - DNA, 43 bp, Homo sapiens
cgtccctcaccgcaccacccctaaagacgctagcgctgcgatg

SEQ ID NO: 606 - DNA, 82 bp, Homo sapiens
gggcctctgcattgcccgactccgtaggagcgcgggggcggctcctgctcttcctggactcctgagcagagttgtcgagatg

SEQ ID NO: 607 - DNA, 90 bp, Homo sapiens
ccgcccttccttcttctcccagcattgccccccccacgtttcagcacagcgctggccgcagtctgacaggaaagggacggagccaagatg

SEQ ID NO: 608 - DNA, 101 bp, Homo sapiens
ccatctttccgtcccgggcagccagcgccagtcggagccagcgcgagccgccgccgccatcactgccgctgccaagtcctccacccgctgcccccgccatg

SEQ ID NO: 609 - DNA, 59 bp, Homo sapiens
gattctctttccgcccgctccatggcggtggatgcctgactggaagcccgagtgggatg

SEQ ID NO: 610 - DNA, 121 bp, Homo sapiens
aactctttcttcggctcgcgagctgagaggagcaggtagaggggcagaggcgggactgtcgtctgggggagccgcccaggaggctcctcaggccgaccccagaccctggctggccaggatg

SEQ ID NO: 611 - DNA, 44 bp, Homo sapiens
gcgccctttcccctgccggtgtcctgctcgccgtccccgccatg

SEQ ID NO: 612 - DNA, 154 bp, Homo sapiens
ctccctccccgcgccccgtcctctcccgccctacaggccctagcagggcaggcgggaggtgagcgcggccatcccgctcccggagttccgggatcctggagtccgtagttcgtggtccttcgccggtgtccccggagcccagcggctgtggatg

SEQ ID NO: 613 - DNA, 23 bp, Homo sapiens
cctccctttctcctgcagccatg

SEQ ID NO: 614 - DNA, 146 bp, Homo sapiens
cctccttttctcccgccggctctaacccgcgcttggctaaggtccgcgggaacccgtgagccaccgagagagcagagaactcggcgccgccaaacagcccagctcgcgcttcagcgtcccggcgccgtcgcgccactcctccgatg

SEQ ID NO: 615 - DNA, 187 bp, Homo sapiens
gcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatg

SEQ ID NO: 616 - DNA, 683 bp, Homo sapiens
cgccctcttttggtcgccccctccccaacccagcactaaggagcaccctgctctggtctccgccaccacccagcgcctcctggacccatccccccaaacccttgaacgtcctcaggacccccaggtgagcgcggcgcgctgcgggcggggaccctctctgcacctccccgcacccctgggggtcgctctgtccctacggtccccgcctcccctttctcctttctaagcgcctcgcgcccaggccgccgcccggggtggcgcagcccgcagccctcccgctccgggcgccctccgccgctccgagaccccctgggggcgcgtcctctcccgctcccctgttccctcccccggctcagggcgggcgcgtggtcccaggggaggctcccgcccagccccgcactcctttgtgcggccgggcgggcgctgcgtcaaggtggaggcgcggccacacgcgcgcacccacccgcgcgcacccagcccccgggagaggcaggaagggaggcggcggcgcgaggaggagggagcggccgtggagcccaatcgttcgctccccttcccgggtccgcgcgcggcgccgcctccgccattgctgcgagcaggagcaggagacgcggagctcggagcgctcagctgacctgccggagccgggcgtgggctgcagcctcggagctcccggaacgatg

SEQ ID NO: 617 - DNA, 152 bp, Homo sapiens
acgtcctttcgatgttgcgtcatgcagtgcgccggaggaactgtgctctttgaggccgacgctaggggcccggaagggaaactgcgaggcgaaggtgaccggggaccgagcatttcagatctgctcggtagacctggtgcaccaccaccatg

SEQ ID NO: 618 - DNA, 322 bp, Homo sapiens
tttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatg

SEQ ID NO: 619 - DNA, 154 bp, Homo sapiens
cggtctcctcacttccggcttcgctgctcttggttctggttctggaggctgggttgagaggtcgccggtccgactgtcctcggcggttggtcagtgtgaatttgtgacagctgcagttgctccccgcccccgagcagccgaggagtctaccatg

SEQ ID NO: 620 - DNA, 449 bp, Homo sapiens
ccgccccttcggcgccaccacgtgtgtccctgcgcccggtggccaccgactcagtccctcgccgaccagtctgggcagcggaggagggtggttggcagtggctggaagcttcgctatgggaagttgttcctttgctctctcgcgcccagtcctcctccctggttctcctcagccgctgtcggaggagagcacccggagacgcgggctgcagtcgcggcggcttctccccgcctgggcggccgcgccgctgggcaggtgctgagcgcccctagagcctcccttgccgcctccctcctctgcccggccgcagcagtgcacatggggtgttggaggtagatgggctcccggcccgggaggcggcggtggatgcggcgctgggcagaagcagccgccgattccagctgccccgcgcgccccgggcgcccctgcgagtccccggttcagccatg

SEQ ID NO: 621 - DNA, 444 bp, Homo sapiens
ccccctcttctgcagcagacggactgagttcctctaatccctgtgttccttctcccccatctttctaaaacccttctctgagagaggaataactatagcttcagggataatatagctttaaggaaacttttggcagatgtggacgtcgtaacatctgggcagtgttaacagaatcccggaggccgggacagaccaggagccactcgttctaggaatgttaaagtagaaggttttttccaattgatgagaggagcagagaggaaggagaaagaggaggagagagaaaaagggcacaaaataccataaaacagatcccatatttctgcttcccctcacttttagaagttaattgatggctgacttctgaaagtcactttcctttgccctggtacttcaggccatatacatcttttcttgtctccataatcctccctttcaaggatg

SEQ ID NO: 622 - DNA, 84 bp, Homo sapiens
acctccctttctctgctcagctccagcgtcatttcggcctcttagttcttctgaaccctgctcctgagctaggtaggaaacatg

SEQ ID NO: 623 - DNA, 77 bp, Homo sapiens
gggtctcttccgcggaaactgacattgcgtttccgttgtcggcctcccactgcaggagccatatattgaagaccatg

SEQ ID NO: 624 - DNA, 371 bp, Homo sapiens
ccaccttttcttgggcttgtaggaaggtggacatgggctcccggagacaagacaagtgatatgttgaactgttcggtggctggaatcaactgctcctggagtgacctaaggccagtgtttatcagaacttagccagggccagccaagcaggcacagatgctctgctatgaaatgccacgcaggcagagactgacaagcggtaggaactgagctttccccttggactgctgcttcctgctgtgttcaggggagggggtcactttctggcaactctgctgctgctgctgctgctgctgctacttcagcttcctctccactcaaggtaagcaggctaagggagggcaggctgctagggaaagctttgtaccatg

SEQ ID NO: 625 - DNA, 49 bp, Homo sapiens
tggcccctcttctcacatcagcgggtccaggcccaaccgacagactatg

SEQ ID NO: 626 - DNA, 206 bp, Homo sapiens
cgtcctccccgctccgggccccacccggctcagacggctccggacgggaccgcgagcacaggccgctccgcgggcgcttcggatcctcgcgggaccccaccctctcccagcctgcccagcccgctgcagccgccagcgcgccccgtcggcagctctccatctgcacgtctctccgtgaaccccgtgagcggtgtgcagccaccatg

SEQ ID NO: 627 - DNA, 387 bp, Homo sapiens
cgccctcttcttccagactctcggtctgtccgctgggggcgcgcgcggtgtgtggcaggcggcagcggcgctggcggccgagtgcgcttgtcacgcgtggcggtgcgtggttgctaggggcgcctgaggctgccgggtagcccagcaggccgagggaggaagtagcgtggagccggtgccgagccggggcgaagctggatcccctagatagactgtcttcaagctcactgatattttcctctgcttgatccattgtgctgttgagagcctctagtaaatttttcagactgacagacttcaaggatgcagctgctactaccggaggtgtgtggcaccttacctcagcaaggccatgagaccgtgtggccatgatgtgggcccctcatg

SEQ ID NO: 628 - DNA, 116 bp, Homo sapiens
acctctccctcctcctggcgttagttccggtcgcagaggagacaccgccgcagttgccggtacatcggggatttctggctctttcctcttcgccttaaattcgggtgtcttttatg

SEQ ID NO: 629 - DNA, 209 bp, Homo sapiens
ttgccctttctgtgtaagctgtgagcgtaggcggccctgagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatg

SEQ ID NO: 630 - DNA, 197 bp, Homo sapiens
ctgccctttgcctcctgggcggagaagctgcttcctcctgggaacaaccgcctcccgctcctagcaggttgctactgccccgaacccgcgctgcagggaacagcggggcaaacagtgagtggggttcagcgtagactctggaccaggagaggcccgcggtgaccgaggcctgggccccggaaaccaatagagccatg

SEQ ID NO: 631 - DNA, 434 bp, Homo sapiens
agccctctttcaccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatg

SEQ ID NO: 632 - DNA, 142 bp, Homo sapiens
ccgccttcccacatcggatcgcagggctcccaaaatggcgagtgaggctgcggggactcgctgagcagcggagggggagcgtgcagagccgctgcggccctcacagtccggagcccggccgtgccgtgccgtagggaacatg

SEQ ID NO: 633 - DNA, 340 bp, Homo sapiens
cgttctttctcccttctctgcctctctctcctccacgctgctttgatttcgctcttgcctctcttcttgcgctgctcagctgggaacatcgtctcaccaggggcagcagcgacgcgctgcacagccagacaggagctggctgcggggcatggaagcagcctccttggcagccgggagaggagcaagcgcacgccactgcccgtgacccaggcgtccggctgctgtcccctgccggggagctcatccacgcagaggtctctccctgtcctccctgcgagcttttcctctgcagagcccagtggagccagtccccacaggagacaaccctgacgggagcatg

SEQ ID NO: 634 - DNA, 129 bp, Homo sapiens
cggcctttctgtgttcctggcccgcggccgtcgggtgtgagctgcgccgaccgctctgagggttcgtggcccaccgctccttcgcggtccctgccgccaccgtccacgctcagcgttgtagagaagatg

SEQ ID NO: 635 - DNA, 78 bp, Homo sapiens
cggcctttctagccgctgtcccaagggttggtctcgcgctttcggctgcgagctctctgtggtgctggcagcgacatg

SEQ ID NO: 636 - DNA, 188 bp, Homo sapiens
ctccctcctttaaacagcttctccgggtctcagcatgggcttccagggcagcgattgaggagaccttaccaaggagcaccacacagtagatgctgagacatcgtactccaggataagaaacagtaacatggcagcacctgcttgaaagaaattaaaaaccaacagactccatttagaaaggaacaatg

SEQ ID NO: 637 - DNA, 61 bp, Homo sapiens
cctcctctccccttgcggcctttctaacgttggccctgctcttgtggcctcccgcagaatg

SEQ ID NO: 638 - DNA, 256 bp, Homo sapiens
cggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatg

SEQ ID NO: 639 - DNA, 327 bp, Homo sapiens
aggcctctcgaggtccagacagccgcccagcccgctctgcgacgcagcagtgaatagtgtggtacctccttgtctcggttcaggtccagacctccccgtcttccggctgccctgaacgtcaggcgacctcaggaccctgtgattggcgcctgcgccggcggaccgtgaccgaggaaacccctggagggacttgggcattccttgggctccgtgcctgttcttcgtgctcctttcgggcaaggatctcacattatcagtctttgaccgacacagaatgcctggcatttgataaatgtttgttgaacttgaagagacatatggacaatg

SEQ ID NO: 640 - DNA, 83 bp, Homo sapiens
ttttccttttcatttcagcctgactgccggaatcagagccgcgggtgagatccccagccctgtgagcctgtaggagtagaatg

SEQ ID NO: 641 - DNA, 472 bp, Homo sapiens
ggttctttgagatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatg

SEQ ID NO: 642 - DNA, 301 bp, Homo sapiens
agcccttcttgattggaagaagcgcctcggaccccggtccttggcgccgtagtggttaggttgagccctaggcgtgggggagaactggggaaactggaatttcccgcggagctgacagcgcttgcgctccccctactcgttctaattccacgcgctccaaaatatccgccatggagaaatcttggccaggatgtccattctaggcccatcggtgctgtcttgctgaaggttgggtcaggcatctaaagggactgtggtaagggagggtgtgacacaggtgtaagctgccatcgtcatcatg

SEQ ID NO: 643 - DNA, 51 bp, Homo sapiens
gctcctctccggccgcgcagccgctgccgcccacccgcacccgccgtcatg

SEQ ID NO: 644 - DNA, 116 bp, Homo sapiens
gactctttcctgtcccggcctgcgtggtgtgggcttgtgggtctttgagacccgaaaattgagagcgttttcgcactccagcggctgctcctggcggctctgcggccgtcaccatg

SEQ ID NO: 645 - DNA, 58 bp, Homo sapiens
acgccttttgctggaagagcgctgctggggttaggattctgcgcggcgaggcaagatg

SEQ ID NO: 646 - DNA, 267 bp, Homo sapiens
cctcctctgcgagcgttatttcaaaagaagttgagaaccagagaaaccgacctaaggggattctcccatttggcccgtcctaccctaaagtcaccacctgctgcttttctggagcgcttaccagtgaccaagaggaacagaacacagagcagcctggcagtgtccaagcaacaagcctccgctcctccttcctgcaccctggggctcctgaaactcacatgggtaaaaaagatacagtaaagacataaataccacatttgacaaatg

SEQ ID NO: 647 - DNA, 358 bp, Homo sapiens
ccgcctctcgagcgctgccggtggccgcagcggcgcacccacgccggcccggaggagcagagtgttcatttctgtgtcgggcacagtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatg

SEQ ID NO: 648 - DNA, 181 bp, Homo sapiens
ccgcctctcaaccatcaggttcggcagcccgcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatg

SEQ ID NO: 649 - DNA, 85 bp, Homo sapiens
ccttcctttctccctctgcagacacaacgagacacaaaaagagaggcaacccctagaccaccgcgaaggacccatctgcaccatg

SEQ ID NO: 650 - DNA, 26 bp, Homo sapiens
tgttccttttggtacgctccaagatg

SEQ ID NO: 651 - DNA, 131 bp, Homo sapiens
tcccctccttccagcgcctttcggtggagcactgcggcactcagcccgagctgccgttttcccctcgcggggaacgctgtgacccccccgcaggagcggcggggcggggtgggggggcccgggagaagatg

SEQ ID NO: 652 - DNA, 96 bp, Homo sapiens
gctcctttccgtggtgtgtagccggcttggcgtgaccctcgcctgatccagttgttagagttggaagcttggcagttggcctcccttcttcccatg

SEQ ID NO: 653 - DNA, 291 bp, Homo sapiens
cttcctttcctagttgggttctgacagctccgaggcagtggtttacacaaccaacacgaaacatttctacgatccacccgattcctcccctcattgatattcaggaagcagctctccttcccctgccttcagctcaagtttgctgagcttttgtttcatttgtgaatacttcttgctggaagtccctcacccagagaccagtgctcccaacggcagagcagcgggggagataaagaactggtgacacgtggctgtacattcagcacagctgtggtgtccccaagtgccatg

SEQ ID NO: 654 - DNA, 125 bp, Homo sapiens
ctttcttttccggattgggcatcccggcatctgcacgtggttatgctgccggagtttgggccgccactgtaggaaaagtaacttcagctgcagccccaaagcgagtgagccgagccggagccatg

SEQ ID NO: 655 - DNA, 30 bp, Homo sapiens
cgctctctgctcgcgcttgggctcgcgatg

SEQ ID NO: 656 - DNA, 29 bp, Homo sapiens
gcgccttttctgacgatgcgaacaacatg

SEQ ID NO: 657 - DNA, 78 bp, Homo sapiens
ccgccttctgccctcagcagcagacgctctgtcccgcccgggcagctctgcgaggcagcggctggagagggaaccatg

SEQ ID NO: 658 - DNA, 135 bp, Homo sapiens
gcttctcctttttgtgttccggccgatcccacctctcctcgaccctggacgtctaccttccggaggcccacatcttgcccactccgcgcgcggggctagcgcgggtttcagcgacgggagccctcaagggacatg

SEQ ID NO: 659 - DNA, 271 bp, Homo sapiens
caccctcttgcccggtccccgggagggccggtccgctcctcccggacgccgaggacctaccaccgcgacttcgccccgcccggcgcgggcccaggaccctgatgtcgcttttgaacagcccctgcacctggcagccagcgagctactgtagtaggcattgccgactgtttgcataccggatgggagtgacagtgtaatagaaaaacaagcaagaaaccttttaggtaggactcctaaggctcagaggaagttacctccagccgctgccatg

SEQ ID NO: 660 - DNA, 209 bp, Homo sapiens
ccttccctttcccggctcaagtccttcctctctctttcctttctttccgcctatcttttttctgctgccgctccgggtccgggccattttccgggccgggcgcactaaggtgcgcggccccggggcccagtatatgacccgccgtcctgctatccttcgcttcccccgccccatgtggctgcggggccgcggcggcgctgcccactatg

SEQ ID NO: 661 - DNA, 31 bp, Homo sapiens
ccgcctttcgtaagtccccccgcctcgcatg

SEQ ID NO: 662 - DNA, 37 bp, Homo sapiens
caacctcttctctcccgcttctctcgctgtgaagatg

SEQ ID NO: 663 - DNA, 272 bp, Homo sapiens
ctcccttctgctggaccttccttcgtctctccatctctccctcctttccccgcgttctctttccacctttctcttcttcccaccttagacctcccttcctgccctcctttcctgcccaccgctgcttcctggcccttctccgaccccgctctagcagcagacctcctggggtctgtgggttgatctgtggcccctgtgcctccgtgtccttttcgtctcccttcctcccgactccgctcccggaccagcggcctgaccctggggaaaggatg

SEQ ID NO: 664 - DNA, 142 bp, Homo sapiens
actcctctagccggaacctgggggcccggagccggggtaggcacagagttgtcctcggaggtccaggacagcggccagcccggcggcgggagtcagggccacgccacctgcagggaagaacccgagtcgaagcgggaagatg

SEQ ID NO: 665 - DNA, 190 bp, Homo sapiens
cttcctcttgcagttgaggccggcgccgagccggacttcaggcggatctcgtggcggagcccatcttgctccctctcccaggcctttacccgctccctaggattcccgggccctgtaggtgggagttgggagacgacagtactgcttttaaagagacagtgttagggatcttggaagcacagccaacatg

SEQ ID NO: 666 - DNA, 84 bp, Homo sapiens
gctcctttccactcgggaaaccttcagaggagtctcagaaaggacacggctggctgcttttctcagcgccgaagccgcgccatg

SEQ ID NO: 667 - DNA, 219 bp, Homo sapiens
gcccctccctctccgcccccaccccctgtcggcgtctgggcctcgtccccttctctctgtctcccttgcctcccccatcacgtcccctgacaccgacaccccattgctcccacagtctccccagtctccactttggtccccagcgctgtctgcccgaggatttgcctgaaggctgcccccaactctgcacccgccccccgagggccaccgaggaccatg

SEQ ID NO: 668 - DNA, 300 bp, Homo sapiens
cacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatg

SEQ ID NO: 669 - DNA, 133 bp, Homo sapiens
cgttcttccgggaaaatggcgactcccgctcgtgccccggagtcaccgccgtccgcggatccggcgctagtagcggggcctgccgaggaagccgagtgcccgccgccgcgccagcctcagcccgcgcagaatg

SEQ ID NO: 670 - DNA, 226 bp, Homo sapiens
tcgcctctttccgccagcgcccgcaggacccggatgagagcgcacgcttcggggtctccgggaagtcgcggcgccttcggatgtggcggatgcggccgtgagccggcgggggaggtgctgctgctgcctccactgtactcagacccaggtagcacaggattgtccatcctccagcagctcagtgcaacggtgtgaactcagcctgtttcagagcctccacaccatg

SEQ ID NO: 671 - DNA, 126 bp, Homo sapiens
cgatctctgcggggcaagatggcggcgcccagacaggcctggagcacggatgaataagagggaacccccacacggagacactgctggagagagtcgtactggggaggcagctggagcagcaagatg

SEQ ID NO: 672 - DNA, 285 bp, Homo sapiens
cctcctctttggtgcctccagccaggaggcgggagcgatccacagcagctgacccagctcaggcactgcctctctcacagccctcaagacacaccatgggcccagaggcaggtttgctacacagcagcgacgacgcaggcggcggccccagcgactcgcaactgcctccctgaccacagcggccaccgcccaacacccccgagaagccatcgccaccaccggcaggagaacctagggtccataaagccatcttcgcgatcgactaaagctacgtcaacaactatg

SEQ ID NO: 673 - DNA, 109 bp, Homo sapiens
ccccctctctcggcccggccatcttgtgggaagagctgaagcaggcgctcttggctcggcgcggcccgctgcaatccgtggaggaacgcgccgccgagccaccatcatg

SEQ ID NO: 674 - DNA, 48 bp, Homo sapiens
caccctttctgcgggggacgatttcgtcggtggtaggctgctaccatg

SEQ ID NO: 675 - DNA, 29 bp, Homo sapiens
gcgcctcttcacgaggtggaaacaagatg

SEQ ID NO: 676 - DNA, 55 bp, Homo sapiens
cttcctcttcctgggcagcctcgggacggggcgccgcggccgggcgggcagcatg

SEQ ID NO: 677 - DNA, 171 bp, Homo sapiens
acttcctttgcctgctcaccgccagcgtaggtgctaccaccgctgccgtcgccgccgccattttgatggcaggaagagtccggttctgggacagctggagacagtggtggtgactgaaataactttaccaaaggaaagctattttgcgaactatcttctccagcggagatg

SEQ ID NO: 678 - DNA, 21 bp, Homo sapiens
agttcttcctttgacaagatg

SEQ ID NO: 679 - DNA, 205 bp, Homo sapiens
cagtcttctcgagcacatcgtcgcaaacggggccggaaagcgtggcagcgcaggcgcaagcgcagagagcggaggcggtggtggtggcggccgctggccagttccttcagtgaatctacagacctattttctcaggagctcagcctggccttacttcagtgataaaaggaggaaaggctggctacagcaaacatcattcaagatg

SEQ ID NO: 680 - DNA, 157 bp, Homo sapiens
ctttcttctcgtcggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatg

SEQ ID NO: 681 - DNA, 749 bp, Homo sapiens
ccgccttctcacactttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccatggaggtcttcacttcagaaatccaagactcatattcatccagcttggtgtcaagtgggctgttgctgccagaattatcttgtgattatttgagagatgtatcagtttcttctgaagtacaatcaactgtagaagcctttgtagcagtttgttgcatattctaaggacccagacataggcttggtggcccgtctcttgtctttcctggtttatgactttcggctttgtggaatacggctgagatg

SEQ ID NO: 682 - DNA, 55 bp, Homo sapiens
gcctcttcttcttccgccctggcagggtctccgcagaagatttgttgccgtcatg

SEQ ID NO: 683 - DNA, 44 bp, Homo sapiens
gcgcctctccagcctccgcaggcccaaccgccgccagcaccatg

SEQ ID NO: 684 - DNA, 69 bp, Homo sapiens
tttcctcttttgtgctgattcctgaggactaggaaggtgccccgaaaagaattcagagacctgacaatg

SEQ ID NO: 685 - DNA, 541 bp, Homo sapiens
ctctcttttctggagttagattagtctgaagccgccaccagccccaggcccccgtgcagaagaaaagcgggagggaacggcggaggccgccgctgccctgcaccgccctcctggaggccacttggagagtccggccccgaggaggccatggccacaagtgcccacagctggccccaggttgccagcgtcgctacagcccagaccaaggcagaataatctccggatgagctggtggcaccgctgagcctttggtctcaccagggcttcctgttgctggcaggcggggtggagcggagctgctgggaggctgctggataggagaggggtcacggctgcggaagaggaggttcttcgggacacccgtggatggacacggcaaggaaacaccaggccaaccacagctggggataaaatagcacaaccacaccctgccgtccagcgcctcccagcctgtgccccttcctagtaccaccagcaaccatcaatcccgtctcctcctgcctcctctcctgcaatccaccccgccacgactatcgccatg

SEQ ID NO: 686 - DNA, 126 bp, Homo sapiens
tcttctctgtggcggagacagccaggttggcagctgacgggacagccggggtctattttgttgcgggttttcagcaaatccagggctggtctggaggcgcgaaaacttaaggcatacagaacgatg

SEQ ID NO: 687 - DNA, 286 bp, Homo sapiens
gcgcctctgtcattctactgcggccgccctggcttccttctacctgtgcggccctcaacgtctccttggtgcgggacccgcttcactttcggctcccggagtctccctccactgctcagacctctggacctgacaggagacgcctacttggctctgacgcggcgccccagcccggctgtgtccccggcgccccggaccaccctccctgccggctttgggtgcgttgtggggtcccgaggattcgcgagatttgttgaaagacattcaagattacgaagtttagatg

SEQ ID NO: 688 - DNA, 132 bp, Homo sapiens
gggccttttctctgcacggagccggcgcttttgcagttgcttctgcggaaaggtggtagttaagaatttgtaaaggccagagaactacctacgattctctcagcggtctctcttctcctcaagtttgaaatg

SEQ ID NO: 689 - DNA, 137 bp, Homo sapiens
cctcctccctccttccgtcctccgcgccttccgtcggtcggtccttgcttcctgcttcgcctccgcgcctcgcgctatgggacagagcccccgatccgccagcaccacctgaggatccagaaaccgccccagcgatg

SEQ ID NO: 690 - DNA, 133 bp, Homo sapiens
ctgtcctttcagcaccacaagctcgggctgaggagggaggactcctggccgtcctcctcctcttcaaattggcttgaatcttctctgaccccccacgagtgcagcacagtctgggaagaaaggcgtaaggatg

SEQ ID NO: 691 - DNA, 218 bp, Homo sapiens
gcgccccttccggcgcggggagggcgctgaagatcggggccgctcggccgcaggccgcctccagcgccgcgggatgtagcgcgggggaccgcggcccccagcagagcccgcctgcccggcttgtctaccatcagagggagatctctgccccctggggctgagagaccccaacctttccccaagctgaagctgcagggtattgaggtaccagccagatg

SEQ ID NO: 692 - DNA, 325 bp, Homo sapiens
ttttcccttgggacccgggtccacacggcggggtcgcccgtccatctccggctcgcccgcggggcccatcgtcgacgttagcggccgttctccgagccgactgacccatccttggcgctgccgccgcgcgcttgttctcctccctcgccccgccttcatcctccccgttcacggaaacgacagctgcggctgcggggctggcgccgcctccctccacctaccacgtctgccctcgccgctctagccctgcgccccagcccggccgcggcacctccgcctcgccgccgctaggtcggccggctccgcccggctgccgcctaggatg

SEQ ID NO: 693 - DNA, 214 bp, Homo sapiens
gtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatg

SEQ ID NO: 694 - DNA, 53 bp, Homo sapiens
ctgcctttcccgggcgctgattcctgagtgctgagcgcgaacccgaggagatg

SEQ ID NO: 695 - DNA, 73 bp, Homo sapiens
atctcctttagccccgcccgcctccgtagctgcctgaagtagtgcagggtcagcccgcaagttgcaggtcatg

SEQ ID NO: 696 - DNA, 28 bp, Homo sapiens
tgatcttttccaaggctgtacagacatg

SEQ ID NO: 697 - DNA, 101 bp, Homo sapiens
cgccctctcgccgcgtcgccggtgcctgcgcctcccgctccacctcgcttcttctctcccggccgaggcccgggggaccagagcgagaagcggggaccatg

SEQ ID NO: 698 - DNA, 164 bp, Homo sapiens
gcttctctttcggagggagtgttcgccgccgccgcggccgccacctggagtttcttcagactccagatttccctgtcaaccacgaggagtccagagaggaaacgcggagcggagacaacagtacctgacgcctctttcagcccgggatcgccccagcagggatg

SEQ ID NO: 699 - DNA, 44 bp, Homo sapiens
gtttcttttgcggctccacgtcggcaccagctgcggggcaagat

SEQ ID NO: 700 - DNA, 98 bp, Homo sapiens
ggttctttctgtgtttgttctctgccctgccaaggccgtagagctggtgcgtgcgggtagcggggctctccgaggagccgcacgccggcggcaccatg

SEQ ID NO: 701 - DNA, 239 bp, Homo sapiens
ctacctccttttccgcgggccccgcccaggcggctgcccgtgacctgcctgggcgcggggaactgaaagccggaaggggcaagacgggttcagttcgtcatggggctgtttggaaagacccaggagaagccgcccaaagaactgatatccaaagagaagaagaaaaagtgaaacgatctgtgaaagatgctgccaagaagggccagaaggatgtctgcatagttctggccaaggagatg

SEQ ID NO: 702 - DNA, 41 bp, Homo sapiens
cgaccttttggccaggttagggagggggcgacgctgagatg

SEQ ID NO: 703 - DNA, 38 bp, Homo sapiens
cgctctttccggcggtgctcgcaagcgaggcagccatg

SEQ ID NO: 704 - DNA, 83 bp, Homo sapiens
ccttcctttccctccggcgtcctctcccggccctctcgcgctgcactgtctctccgacgcaagactgtcccggcccggatatg

SEQ ID NO: 705 - DNA, 44 bp, Homo sapiens
cgccctccttgccgcccagccggtccaggcctctggcgaacatg

SEQ ID NO: 706 - DNA, 83 bp, Homo sapiens
cgccccttcgcggcgcttcctagttcggctggttcttctgtcgccggcttcagcagcccgcgcccgggcaggaatagaagatg

SEQ ID NO: 707 - DNA, 118 bp, Homo sapiens
cgttccttcgccgccgccaggggtagcggtgtagctgcgcagcgtcgcgcgcgctaccgcacccaggttcggcccgtaggcgtctggcagcccggcgccatcttcatcgagcgccatg

SEQ ID NO: 708 - DNA, 202 bp, Homo sapiens
ccgcctctcggccccgcggcctggccggcaagcagggctgcagtcacggggcggcgcggagggccccagcccagtcaggggtgtggccgccgccaccgtaaggctaggccgcgagcttagtcctgggagccgcctccgtcgccgccgtcagagccgccctatcagattatcttaacaagaaaaccaactggaaaaaaaaatg

SEQ ID NO: 709 - DNA, 46 bp, Homo sapiens
cgctcttttcattcacgaaggtagtgaggcctagtggaaagccatg

SEQ ID NO: 710 - DNA, 13 bp, Homo sapiens
cctcccctcgatg

SEQ ID NO: 711 - DNA, 604 bp, Homo sapiens
ccccctttccggcaggctactgggctccgcccacacacctcccggcctggttcctaaacgccagctcggagcaatccccttgggctggagccaaatccctgctgtgattttaaggaagaccggcaggtccgggcccccaagggtcaaccccacacacatccccgcactttcctgtatgcaggcctgcgagcgtagagggagtggaattcacagcctccccacccatccgcaggggtctcctgggaggaacccaccagcgataggaacactgaagctgggctacggcgtccgcccgagccttttcttaaaggcgccgaccccggaagcggggcgtccgagggagcgcgcgacgggccacgcacgtccgggcgtccagttcggggcagcttctccggctggtgggtgggtggggcagcctttcaggcagggtggcaaccaactatatctgaggaccagagccattttggggcaccagagcttgtgacctctccatctccacccagctgggtccaggggccactctcagcactcacctcagcagctgacatcataaagcagacttgggaacctggaagcactctggagaacctttccctgagacatg

SEQ ID NO: 712 - DNA, 67 bp, Homo sapiens
cgccctttcagttctgcttgctgtcggcaccgctgcgttacccggaaccgccgggccgaacagcatg

SEQ ID NO: 713 - DNA, 99 bp, Homo sapiens
ggttcttccttttttatttaccggtggctgtgcttccaatttaggaagaccccggcgacctgttcctcacccccgcttcgccctcacactttcgggatg

SEQ ID NO: 714 - DNA, 23 bp, Homo sapiens
tcgcctcctccctccccaagatg

SEQ ID NO: 715 - DNA, 120 bp, Homo sapiens
gttcctccttgctctcgcccctactctttctggtgttagatcgagctaccctctaaaagcagtttagagtggtaaaaaaaaaaaaaaacacaccaaacgctcgcagccacaaaagggatg

SEQ ID NO: 716 - DNA, 504 bp, Homo sapiens
tagtctttccaggtgttagtcgaaacctcgtggtgcgaccctggtcgtcccaaaccccctaggccttaatcctggggcggtgggggcggggaggccgtgagcacggcttccgctcctccaatccgccagagggcgcagcggccggcctctcccttcccggggttcttcgcgccgggccccttccgcgtgggtgagtgaatgtgagagtcagcgctcgcgccgcgcgcgccgcccgcctccgctgttcggcgctctgctttaggcggtggggggcgggcgcgcgcgtaaaagcatagagacgggcattgagctcttgggctagagcgtcgccgagtcggagccggagcctgagccgcgcgctgtgtctccgctgcgtccgccgaggcccccgagtgtcagggacaaaagcctccgcctgctcccgcagccggggctcatctgccgccgccgccgcgctgaggagagttcgccgccgtcgccgcccgtgaggatctgagagccatg

SEQ ID NO: 717 - DNA, 86 bp, Homo sapiens
agctctctagcagagcgccgttgctgggggaatgcagaagcggccgcgggctagcaagctcccggagccggcggcgcaccaccatg

SEQ ID NO: 718 - DNA, 333 bp, Homo sapiens
cctccttttcttcctcagcgggtccgcggcccgctactctccgggaggggcgcttcccgacgccaaggtaggcctctcccgacgccggggcggcccttcctgatgccggggtgtgtctctcgcgacgcgggggtgggctccggacgccggggctggccttgccgaagtcgggggtgggtccctccggacgccgaagtgggctcgggatgcggggctgggaccctcccgattccggggcggattccggacgccgggaccggccattactggtgccgggttgggcttctccagatgccggggctgggtccttcccaaggttgagacaaaaggatg

SEQ ID NO: 719 - DNA, 63 bp, Homo sapiens
ccgccccttcccatcgtgtacggtcccgcgtggctgcgcgcggcgctctgggagtacgacatg

SEQ ID NO: 720 - DNA, 28 bp, Homo sapiens
cagcctcctttgcgggtaaacagacatg

SEQ ID NO: 721 - DNA, 53 bp, Homo sapiens
cttcctctcaagcttggcgtttgtttggtggggttacacgcgggttcaacatg

SEQ ID NO: 722 - DNA, 203 bp, Homo sapiens
taccctcttctgttgctttctccctgtggctcgcgccgtcccccgccgcccgtcgaccccgcttccatgtccctggcggacacagctcccaggaacctccacgcccatggccactaggcagagggaatcctctatcacctcctgctgttccacctcgagctgcgacgcagacgacgagggcgtgcgcggcacctgcgaagatg

SEQ ID NO: 723 - DNA, 306 bp, Homo sapiens
cccccttcttttgtggtccggcccattgcgagggtgacaggaaaccctgtgcagggagcgccgccatcttggaccagcccgaggaagatactgagggagcacaggagcagtcaccgctgccactgctactgccgctactgctgccggcgcgtctgcacctctcggcctgccagtgtacctgccggcgcctcggtcgaccgcccccgccccctctcccgctgcgtccgcactcctgttcctggtcctgacgcccccctcccgcccggaaagctgcccagccaccagcaaccccccagtgccaccatg

SEQ ID NO: 724 - DNA, 145 bp, Homo sapiens
cttccttttcctgtttggttttaagtaggctataaaaatcaagttgctgtcttcagagggtctgtggtcctctgatcaacataggctggtgggagtacaggactcgcctcctcagggttccctgtgctgccacttttcagccatg

SEQ ID NO: 725 - DNA, 513 bp, Homo sapiens
ctctcttcccctctccctctccctctgccgggtggatgctttctccatgtggcaaggctgtaactgttcacagctgtctgaaacagcagtggaccaggagcagcttggagttttaactttcattttacaaagaacaacatgtttgaatgtttcagcaggcaagttataactggcatctacttcttgttcttctagaacaccgaaaatctctcccagcactttagaaaggggaccctgactgtgttaaagaagaagtgggagaacccagggctgggagcagagtctcacacagactctctacggaacagcagcactgagattaggcacagagcagaccatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaaatg

SEQ ID NO: 726 - DNA, 27 bp, Homo sapiens
gtttctcttgcgccctggtccaagatg

SEQ ID NO: 727 - DNA, 320 bp, Homo sapiens
cacccccttccacgtcagccaaggactctggagccgccgccgccgctgctgcggttcatagccggagtagacggagccgcagtagacggatccgcggctgcaccaaaccactgcccctcggagcctggtagtgggccacaagcccccagtcccagaggcgtggtgggtcgggcagagtcggaagaactggctttctagctggaagatgcggaaggggagcgactaggccgcttgcgtctgggcctggcagaagggaccggattttctggcatccttaaatcttgtgtcaaggattggttataatataaccagaaaccatg

SEQ ID NO: 728 - DNA, 69 bp, Homo sapiens
gggtcttttgcggctgcagcgggcttgtaggtgtccggctttgctggcccagcaagcctgataagcatg

SEQ ID NO: 729 - DNA, 109 bp, Homo sapiens
ctttctttttctccaaaaggggaggaaattgaaactgagtggcccacgatgggaagaggggaagcccaggggtacaggaggcctctgggtgaaggcagaggctaacatg

SEQ ID NO: 730 - DNA, 182 bp, Homo sapiens
gtgcctttccagtggacctgggctgttgttgcggttgttttccttctctccgtgcaacgctggcaagtctcaaagtcgccacagaaacatgcccctgattcagtgcctctgcttagctgtaacatgttaatcagaactacctggcatcttcctgaacaagactttcaataggggccagtatg

SEQ ID NO: 731 - DNA, 56 bp, Homo sapiens
agatcttcttccgggcggacgtggagccggaagcggaggttccgggctccgggatg

SEQ ID NO: 732 - DNA, 77 bp, Homo sapiens
cgtcctttagccgggagcctgtctttgcttgcctttgcctttgaggctctgtggctgtggggctgagtggcatcatg

SEQ ID NO: 733 - DNA, 85 bp, Homo sapiens
agctctttccccgcgactgcgccacgtctgaggcggctgtggccgcgtcggtgtccgcgtcgaggagccggggcagggcacgatg

SEQ ID NO: 734 - DNA, 152 bp, Homo sapiens
ttctctctttcggccggcgccgccagttcctggggcacacccagaggtccccttctcgccgccgcctgcaactgcgagggtagcccggggccgcttggagtcgcccggacctgagaggctgctgcactgggcctcagccagccctccggatg

SEQ ID NO: 735 - DNA, 359 bp, Homo sapiens
cgtccttctaatcctagtcttcgtttggtccggttgcactcttcctatagcccagagggcgagagggcctgtggcctgggggaaggaggacgaggttctgcctggatcccagcagtaggacgctgtgccatttgggaacaaaggaatagtctgcctggaatccctgcagatcttggggccggaggccagtccaacccttggagcaggaagaaacgcaaagttgtcaagaaccaagtcgagctgcctcagagccggcccgcagtagctgcagactccgcccgcgacgtgtgcgcgcttctctgggccagagcgagcctgttttgtgctcgggttaagagatttgtcccagctataccatg

SEQ ID NO: 736 - DNA, 188 bp, Homo sapiens
cggcctcccgcacgcaccgcgcagcctgctgtgcccgtgggtcccgagtgctccgccgcccgccccgacccgggcccagccgcctccacggcccgcgctcgtactggagcgaagagcggcctcctgaaggaggggaagggacgtgggggcggccacggcaggattaacctccatttcagctaatcatg

SEQ ID NO: 737 - DNA, 201 bp, Homo sapiens
tctcccttttttccttcttccttcccctcctcgccgccaccgcccaggaccgccggccgggggacgagctcggagcagcagccagagtttattaaccacttaacctctcagaactgaacaaagacaacattgttcctggaacgccctctttttaaaaaagaaagcataacccctactgtagaactaaatgcactgtgcatg

SEQ ID NO: 738 - DNA, 505 bp, Homo sapiens
cggccttttgtcagcgcgcagggccaggagagctctcatttcctcccagcctcgtgcgggaaatggctttaattctgacggcagggctgtgagggactagcgggaacccgagccttttgtcaaggaactgcggcgtcggtggccagtcatccccgccgccgcggagccgctgcactgctgggggatctcccagcagctctgacgagcgcgggctgcagcatgggcagaaaacgctgccctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatg

SEQ ID NO: 739 - DNA, 112 bp, Homo sapiens
ccgccttccggctccagtccccgggctcggcctcggcgaggtgtaattcgcagcgcgggccggccccggaggctctcggcgagcgcggcgcggtaacaagtgggcgaggatg

SEQ ID NO: 740 - DNA, 581 bp, Homo sapiens
cgacctctacttccacctctggccccaagtacagcgccagctgcggcctcgggagcgcccgcgggggtgcccgtgcaccggccgcgcctcctccctggcgcgggactcggccgcagctgcctcggaccccggcacgatcgtgcacaacttttcccgaaccgagccccggactgaaccggctggcggcagccacagcgggtcgagctccaagttgcaggccctcttcgcccacccgctgtacaacgtcccggaggagccgcctctcctgggagccgaggactcgctcctggccagccaggaggcgctgcggtattaccggaggaaggtggcccgctggaacaggcctcagttcctgcttttgaaaggaagagggggagtctgtgacccctgaggcctccttgcaactctgttttccaagctttgcacatcttccgaatttcttcttcaaagtctaccctaatgaaatatcagacaattttccaagtgtgcttcatgaacttctgggaggtgcttcacagtttctgcaaatgattgattgaattttcactttgaaaaaatatactttaaggcgacacaagatg

SEQ ID NO: 741 - DNA, 45 bp, Homo sapiens
ttttctttcctggtgtcccgtcgcggcttgggacccggcaagatg

SEQ ID NO: 742 - DNA, 96 bp, Homo sapiens
tgctccctctcccacaaggcagcgcgccggctcggacgcggccggctaccgagccctttgtgagggctgtgagctgcgcctgacggtggcaccatg

SEQ ID NO: 743 - DNA, 24 bp, Homo sapiens
gaatcttttccacagcccaaaatg

SEQ ID NO: 744 - DNA, 307 bp, Homo sapiens
gtttcctttgttgtgagctgcggcagagactggtggctggaggagacgccggcgctggagagtgcgctgcgccgcccgccgctgagggaccgcggggttagccactgctggctgcttccagtgttcgccgagaggtaccgggggtgacagctccgggaccggccgaaaggcgaggaaccggtgtggaaattaaaagaacacacatattttgactggggctttgatcaaccaaatgctaaaaagccacataaagaagatccctaatagtcatttctcaacaattatatagtcaactgatgtaacaatg

SEQ ID NO: 745 - DNA, 18 bp, Homo sapiens
ctccccctttccaccatg

SEQ ID NO: 746 - DNA, 308 bp, Homo sapiens
gcttccctcttctctcgccgcctcctggcctccgcaccgacgcggcccgggctggagccgagccggggccgagctgcaggccggaccggagccggatctgtacccgctgagacgtggaaacatggaggcctgagccggtgtgcgccacctgggctgcggcggcgacagcgacttctcctgacccctctgccaccctcccatccgtccgcgggtccgtggagctggagcagatcccccagccggctgagacaggttgtcttttggaaatgcaggtttaaggacaaattatctgcttaagctagaagatg

SEQ ID NO: 747 - DNA, 144 bp, Homo sapiens
cctcctctttctcctcctcctcagggctccagtcaggccgatccgctccgctcacggaaggaaaacagaaataacttgctggcttgtctggagtcacatgtacttaggtgacaatttacagaaagtcatctctgcagcttgatg

SEQ ID NO: 748 - DNA, 91 bp, Homo sapiens
cgttcctttgtgctgcggcggcggcttctcgagtcctccccgacgcgtcctctaggccagcgagccccgcgctctccggtgacggaccatg

SEQ ID NO: 749 - DNA, 64 bp, Homo sapiens
ctctcctttggcttggggctccggagttgccactgccgccggcgctggtaagcttttcaggatg

SEQ ID NO: 750 - DNA, 87 bp, Homo sapiens
tgacctctttcgggtctctttgaatctccgctgtagcgtcacctggaaggcagatctaacagagaacctggactgtctcctatcatg

SEQ ID NO: 751 - DNA, 284 bp, Homo sapiens
ccgccttctggacttggtcttagttcccagtcgcggccaaatcacgcctcagccacctcccgcaagcctctcactgcctcagccacgctttccaggctggtttctggtccccatccgcggctggtccggccctgggaccgaatcacttcccagcgagaggaaggtcaaatttctcgaccggctacgggaaggtcgcggccgccgccctgtcagccgcctcggcgcccccaggacccctcgggtctctttaaccggaagcggaagtgcgtgtcggcgggatcatg

SEQ ID NO: 752 - DNA, 17 bp, Homo sapiens
cagtccttctcagcatg

SEQ ID NO: 753 - DNA, 297 bp, Homo sapiens
cgttctttgttctgtccccggtgtgtgggtctgtgacagggtccaacagggcctggtccgtgtccggtcccccaaatctgtcgtccctgcccccaggcattggcatcaacaaaagtcagaattcccgggaacttgaacagaggctgctaaattcccagtaattgctcctttggccttctagggactgacttcaaagaaggaaggaaagaatcaggcagtgcttcctcattctcttttaaaacccgcttcccgctgagtctgcacccaggagaccagagagcaccttgcccttccatg

SEQ ID NO: 754 - DNA, 250 bp, Homo sapiens
ggttcttctcctaggcggaagccagaccagagagcgtgcgtgtttttcccagggtgccccgcgctgctgttatggccgcctccttgaggtagtatccgcacatggaattctagggccgcaggtgtatttacggtaactgtcgccactagatttcagcgcctttggactctcctgttttcactttcttttgttgactcccgtgtggccctcgtgggagcctgttttggctgcagcggtgtctggggtgatg

SEQ ID NO: 755 - DNA, 33 bp, Homo sapiens
gtttctctttcctctcagtttgcgcacaccatg

SEQ ID NO: 756 - DNA, 81 bp, Homo sapiens
tgctcttctcgttcccgagatcagcggcggcggtgaccgcgagtgggtcggcaccgtctccggctccgggtgcgaacaatg

SEQ ID NO: 757 - DNA, 57 bp, Homo sapiens
cctcctcctggacggcggcagcggcggcgcgaggagccggcgggcagcggcgcgatg

SEQ ID NO: 758 - DNA, 149 bp, Homo sapiens
gcgccttctccttgcttctgggggtcgtggccttgctcccgctgtgcgggaaaagaatccaggcccttccacgcgcgtgtgggtgcgggggccccgaagtgctcgtggttccccgctaggtctccgctggggcaggaaccggaatcatg

SEQ ID NO: 759 - DNA, 244 bp, Homo sapiens
cctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccaggattagaatcccaagaaaatcaaatg

SEQ ID NO: 760 - DNA, 66 bp, Homo sapiens
ccgcctctttcccgccgccgcctgggaggggacccgggctgccaggcgcccagctgtgcccagatg

SEQ ID NO: 761 - DNA, 162 bp, Homo sapiens
cttcctttccagcctcccgccctcgtctgcttccggccctgtggcctggtggggctctgcaggctccctcgggagtggtccttgggccgtggcccctctgggaggcctgagggagctcaatcctggtagcaacacccctgaattcctggtggtgaaaggatg

SEQ ID NO: 762 - DNA, 277 bp, Homo sapiens
agttcctttatccctgggcccaacctccccgccgacccgcggtccaggcctcggtctctctcttcggcggcgagccgcggcccagaccccggcagaggacacttgtcggcacgttctcacccctgtcatctcagccccctgcctagctccaccccaggcttgggaacccggcccctgacggcccattgtccgcgggcccagcccccgcgctgaacgcacgctcgcccttgcccctaaccagcgcgtctaccccggcaacgcgcagtgacctgggatg

SEQ ID NO: 763 - DNA, 252 bp, Homo sapiens
gtttcttttctgcgcttgtgcgttttctgttcggtttccttcccgctagcggggccacgagggttgctaggcaacagcccctgggtgacttggtcttagggtcctgtccggcttggggctgatgaaaggagctgtccgcgcccgggctcttccgagaagtggttgctgacagccacaaagtgaaagggagtgaggcggcgtggacgagtaaggagtgacagtgaggattcacatttgggttatttcaagatg

SEQ ID NO: 764 - DNA, 96 bp, Homo sapiens
cgtccttcctggtcctgcgggtccaggactgtccgcggggttgagggaaggggccgtgcccggtgccagcccaggtgctcgcggcctggctccatg

SEQ ID NO: 765 - DNA, 205 bp, Homo sapiens
ctccctctggggcgcgggcctcagttccgggctacagcagccgacgccgagaggcaccgtttcttcttaaaagagaaacgctgcgcgcgcgaggtgggcccctgtcttccagcagctccgggcctgctcgctaggcccgggaggcgcaggcgcaggcgcagtgggggtgagggcgcgtgggggcgcacagcctctggtgcacatg

SEQ ID NO: 766 - DNA, 28 bp, Homo sapiens
tggccctttcctttccgcgtgtagaatg

SEQ ID NO: 767 - DNA, 371 bp, Homo sapiens
tctccccttctacagagttcctccggcgcttcctccaccccgggatacacagaacctcatctcctacggtgctgaagcctgcagcagggcaggatgggcaggagagcagagccgcggagtctgcggcgcgggtgaagagcggcgcgtaattcccgcagcaagattgttccgcgcccgcagcccctggactagcaggatccgaaccccggcggctgcgtgcttataggcgcagacgtcagagagcccgcggcttaaagcgcgtcgcctggctagcgccaccccctagccttcttcaaggcctccagggctgggcccaagcgcccgtcgacggcaccctgggcccagaggactcgcgggcctcatctccaatg

SEQ ID NO: 768 - DNA, 512 bp, Homo sapiens
agttctttctgatagcaggcagccatcttgcctggagcctgagaaagggaggagagacagaaggaaccggcgacagtggtctcagggccgctccggggggcctcaagaaccggaggcagccccggaggtggtccccgatcccgggctatgctcttggatctgagaagggaaggcggagggcggcggggacaagatgggtggagaatgtcaagcaaggaatgctaggcgggggaggggcgttgctatggcgactggggaggggcggtgtctgttctgaatcgctgtgtgtcacccgggcgctgcccaggaagggcagggctggggtgatgaccatggtaacacccgggggggagttcgtgacatctccggcgcggagggactcgatgtctatggcaatggtcgcctggtggaagggacggaactagatcccttcgctcgggacgctcacattccaggcccttgtcctgcaggctgccgcgggcggacacgccagaggaggaggccggggaatg

SEQ ID NO: 769 - DNA, 71 bp, Homo sapiens
ccgccttttacgacgcgccggaaagcaacggcaagggcggcagccagcaccgggcggagagggctaccatg

SEQ ID NO: 770 - DNA, 126 bp, Homo sapiens
ctgcctccttctactcgggcgccccggcggccgccacctctccccagcccaggagaggctgcggagccgcagccgcccagaccgcgcagcgcgggaggcaggttccgcacgaaataaatcagaatg

SEQ ID NO: 771 - DNA, 126 bp, Homo sapiens
ttccccttttggggacagatcccgaagttcgagcatccctcggataggccgggtgtcaggcctggtctctcaggcccgtccaggcccatcttgacgattccaagaccacccccttgagcaagaatg

SEQ ID NO: 772 - DNA, 124 bp, Homo sapiens
ccgccctttgccactccccctgcctcctctccgcctttaacttctcgggaagatgaggcagtttggcatctgtggccgagttgctgttgccgggtgatagttggagcggagacttagcataatg

SEQ ID NO: 773 - DNA, 363 bp, Homo sapiens
agtcctctcgcagctgcgccaggacagccggcgcgcggccgtgcccacaagttgccggcagctgagcgccgcgcctcctcctgctcgcagccccctacgcccacccggcggcggtggccagcgccaggacgcacatcccgcggacaccgaccccagatgtaaagcgggaccccagcccctcgccccccggcgcgatcgacagtctcgccagcgtctcctctgccaaaacccagggctggaagatgtggcagccggccacggagcgcctgcaggagagatttgcagacacagaagcggcacagagaaggccattgtgaagatcaaggcagaaaccggagttatggcatcataagccaaggaatg

SEQ ID NO: 774 - DNA, 167 bp, Homo sapiens
tttcctcctcctcctcctccgcctccgccgccgttgcttgaatggtggagccgaagctcggctcgtgaacacacactgacagctatagggcaggcggcggcaccgtccccgcttcccctcggcggcggggtgtcccgtcggcggccctgaagtgacccataaacatg

SEQ ID NO: 775 - DNA, 130 bp, Homo sapiens
tggccttttttgggcgtctccctgctccgcggcccgggctggcgggcgggcgctcggctggcggctgcagcagcagagggagacccgcggcaaccccggcaacccagggctcggcgtcgctgccaccatg

SEQ ID NO: 776 - DNA, 656 bp, Homo sapiens
aggtcttttagtctttttccccctcccttactcttcgtccccggtccctcccctccccacccctttccttctagctccgacgtttgcggccgcgggggcggcggaggatatggagtaaagccagagtcagtggccaggcacgaaggcagagcaggaacagccaggaggcgtttattaggggggcggggggaaagagccccagcaccgcccctcctggaagaaggaagaggtaagtgaccggccgccggcaccgaccgacctccctcaccggcggctctctcgcctgggctcccggagccggcgaggagggaatggaggactcgcgcccgggttaggcctcccagggccgctcaggctggtgggtgttgcctggtgacgggcctgccggcggccggccgggcgatcggcggtcggcgcccgcgcaaagcggggctggacgagcagcgagctccggggagcggatccgagagggccgagtcctcgaaagaggccttgaggcgacgggagacccgggatcgaagtcagctgccggagggagagccccccatgccggctcgagagctcgggtttcggtggtggagaacgtagtacctttcggggacattggacactactctaggaccgggtaactataactacccaatattgcagccatg

SEQ ID NO: 777 - DNA, 215 bp, Homo sapiens
caccctctctcctagtacttcctgttctcggctaaccctggcgctgggccgggggctggagagtgaccgtggtctgagtgacctggggcggctgcgtgggccggggtgggcctcaaagccgggcaccagacgggaggggcggcgctcgggccgcgcgctgcccgcgccgggtcctggcgggcggcgaggctggggctgactcctgcctcaggatg

SEQ ID NO: 778 - DNA, 32 bp, Homo sapiens
cgacctctggctaacctacccccggagccatg

SEQ ID NO: 779 - DNA, 34 bp, Homo sapiens
cggccccttccggttacgaaaccttagcaagatg

SEQ ID NO: 780 - DNA, 166 bp, Homo sapiens
tctccttttgcgcgacacggtctcagctgttccgcctgaggcgagtgacgctggccgccaacgaggtatacgtactgggaccctcgccctcagtctcgtctccggcgcggctacctgccccgttttccctgtgagttgacctgctccgggccgcgggccgccaatg

SEQ ID NO: 781 - DNA, 42 bp, Homo sapiens
cggtctcctgtacgccctagactaggggccgccatctccatg

SEQ ID NO: 782 - DNA, 133 bp, Homo sapiens
ttgtcctcttcgctgctccgtagtgacggggattgttgtgttgcagaaatccggcaatcgacctgaggacttgcgagccgctcagctcccgggacgtttggagctgctgctaaataatttctgctcagccatg

SEQ ID NO: 783 - DNA, 33 bp, Homo sapiens
ggctctttctcctccacgtggggacgcaggatg

SEQ ID NO: 784 - DNA, 74 bp, Homo sapiens
cgctctctctcactggcacagcgaggttttgctcagcccttgtctcgggaccgcagcctccgccgagcgccatg

SEQ ID NO: 785 - DNA, 181 bp, Homo sapiens
cgctcccccccacgtgtccgccggagtttctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatg

SEQ ID NO: 786 - DNA, 217 bp, Homo sapiens
gagcctttgcccgccagcgccttcgctctttggctccctgagttagtccggttgcttgcgatcgccgcggccggggctgcgaaccgaagggctcgctccgcgccgcctgggtctctacctcatccgtaggtgtggccctgatggtgtggcaggctctggactcctaaagctctggagcgaatttaagattttattcatgtgcatggcatagaagatg

SEQ ID NO: 787 - DNA, 270 bp, Homo sapiens
ccgtctttctggaaacaccgctttgatctcggcggtgcgggacaggtacctcccggctgctgcgggtgccctggatccagtcggctgcaccaggcgagcgagacccttccctggtggaggctcagagttccggcagggtgcatccggcctgtgtgtggcgcgaggcagggaagccggtacccgggtcctggccccagcgctgacgttttctctcccctttcttctctcttcgcggttgcggcgtcgcagacgctagtgtgagcccccatg

SEQ ID NO: 788 - DNA, 104 bp, Homo sapiens
ccttccttccccggggtagaagtccagggtgagaaattggttccgaactcaaaggaacccagtgccgggccacagccgggtcacgtggccggcggccccccatg

SEQ ID NO: 789 - DNA, 173 bp, Homo sapiens
attccttctctgcatcgaaggatcaggaagtttgtgctctctgcgtggctaagtttttcacctactaggacgggggtggggtggggagaacaggtgtccttctaaaatacagcacaagctacagcctgcgtccagccataacccaggagtaacatcagaaacaggtgagaatg

SEQ ID NO: 790 - DNA, 240 bp, Homo sapiens
cgctcctcctcttcgctgccggtgggcaccgccgctcgctcgcacttctgcgcccattggagcttcggagatccctgcggtcccgcgggacggcgcggcagcagctgacctcgcagacaggatcttgctctcttgcccagactggaatacagtggtgtgaacacggctcactgcagcctcaacctcctggactcagagatgtcggcttatttataggaattgcttgaagccagagtcatg

SEQ ID NO: 791 - DNA, 205 bp, Homo sapiens
cgtccctttaagagcggctggccaggcacggcctccgcctctcagtacgcggagcgccggcggtcacctggggctcgcggagcggccagatcgcggcggagtcggcgcgcttccccgagggaaggtgggagaggggacccggacgcgaggtgccccgaagccctctcgagcgtaaccgtcccgcgcctctctgaggcggaggatg

SEQ ID NO: 792 - DNA, 903 bp, Homo sapiens
ctgtctcttggctcaggcttggaggcctccgagcagcaacatcgtcccaattataccccgttggagcatcttcagatcttccactcttttcacaacgcaatcaaaatcttcgtacccattttgcagtagtgatctctgtaagttgctttacaattcataaagtttattctatttgatcttcactctaatttacaaagaaaagcagggaagtctatttctgttttacagaggtgtacagggaggctcacaggggctaagttcacacagtaagccctcgaagctgccagggctgcaaagcccaccctctttccaccgcaccgaactacctcctttcgcctacaaaacgtaggtggggaccactggtgttggaatgacggcccacctcgagtttcaggtgacttccactctgcaattaacttgcaggcagccccagacctgcaatgaacacacgggtgggggagagatatgcacgccagggtcagtgggaaccaacagccgaggggtgagcggggctaggggccccgggccgccggcggggcaaacgcggttcagaaacgcaggccgcgctctggcccgccccctgcagcagcacggcctgctcgccatcgcccggagagcgccgcgggttcccgagtccgggcgcggagggcgcgcgggcacggcggcaggggcgtgctcggaggacgcgcgctgcgctgctcctccaaagggcagctccgggggaaagagggtggcgtcccggggaagcccgcagccgccgccgatgtcgctgggactcggaagtgccgaaagaggggtgttgggaactcgcggcgcgcgtgaacgttgccgtcgccgccgcccgggacagcccggagaaactctcagcgtaggcatcgggaaccttcgtgccaaggagccatg

SEQ ID NO: 793 - DNA, 633 bp, Homo sapiens
cctcctttttctcccaaaccacttcttcccccctaccccccgccacgcgaggctgcggcgcacggtatgggtgtgtttgtgtgtatttgtgtggggagggcgtttggagggaaggttaccgggagctccgaggccgctggggaacagggatcccggtgacaaagatggggatatttcctctgtcttccacttggaaacctcaacccccgcttcaggctccctagatactttctggggcccaaccgaaggccgtagccatccaaagcgttcccagcctttctggggagtgaaacttacccccggggttcgtcctagaggagcgtgagcggggaatgcccaggtcaaccgggctgtccgaattccgccccggctcagcctccggcctcagtccgggagagagatctgcctgtcggtctgggctgggggaaacgcggcagtggcctgggccacaggtgagggcagagtaaccagtgggaaggctgcgttttcacgaaggactcgggtgaagctgcagagctgcctttgagccctgactccttggcttcctgggtcggaggagatcttgtaatggagtggttcttcgtctcactagcaagatgcctgatttcctcaggatcaagggattgaagaatg

SEQ ID NO: 794 - DNA, 414 bp, Homo sapiens
agtccttcgccgcattggggcaaaataatcccttcatttttgtgaaggtaccgtggaaaatatttcatttttcttctcaccggagcaattgtaaatgctatgcggtaagaggagttacctgtggaaaggtggttaagagattaggtaaagaaaaggaaaggacaccaaaataaagtgctgcggaagaatttttgtccagctgtgagacgacgagtgcgtgaagtgaaggcgattgagaggggctgagggaattgtcctctgtggaagggactttcttttggccctaggccccttcctgcccctgtcgtcagcagagtctctacaaggaagataacggactgtaaaattctataaagcaaagctacacatcacttgacaccatacaccatcttggttacataatgaagagagatg

SEQ ID NO: 795 - DNA, 71 bp, Homo sapiens
atgtctcttgacagcggcggcggcgcagccggttccgggttcggcgcggggcggggatgtgaatcccgatg

SEQ ID NO: 796 - DNA, 99 bp, Homo sapiens
ccatctcttcccttaggtgtttaagttccgcgcgcaggccaggctgcaacctgacggccagatccctcgctgtcctagtcgctgctccttggagtcatg

SEQ ID NO: 797 - DNA, 52 bp, Homo sapiens
cttccttccaagaaccttcgagatctgcggtctggggtctggttgaaagatg

SEQ ID NO: 798 - DNA, 78 bp, Homo sapiens
gcaccccttccgcgcagccccctgacctgcagcctccggacctcgctgcagcgcggacccggcccgcccgcccgaatg

SEQ ID NO: 799 - DNA, 161 bp, Homo sapiens
ccgcctcttccgctctacagcggaggtggctgtggcggtggcgctggtggctgcggcggcggcggcggcagcggcgctcgagcggttcctgtcagggtcagccggcgggccccctgggtggtccacctgcaaatcgcggagcggcgccccagggatcgatg

SEQ ID NO: 800 - DNA, 38 bp, Homo sapiens
gcgtctcttgtttgtgcggctgaccagttggcgacatg

SEQ ID NO: 801 - DNA, 721 bp, Homo sapiens
cgttcttttctttgtatttccgcctctcgcctctctctaaaagccgcagttagaggcgagatttaggaaaaacctctgccgagtgagcctctggttgggaatatgtatgagaaaaaaaaactggcaaggcgttagtcaagcaaagctgaaggcagaggaaatttgatatctggctggagtctagaggatttaatgcaaataagatactctgagggcagcgtggcaaaaaaagactacaattcccggtggtcacagcgtttgagaagcgatgctttctgagacttgtagtaactaggagctgtgtttgaactatccaggctcaggacagcctcttgaaaaaaaattttttattaataaagcggatttgagtgggatctttttcctaatcgattacgggcccacacgtatgggaagaattctaacaatgattaaagggacatgctacctttacgactatccttttctaatcgatgactcctaaatctaggagtaggtagtcgatgtttgtggtctgggcgtctgtagaagggcaacctcgtgctttctgcagaggagaccggagggcagaaggcagagtccaggcttagactgcagttcctcgcttacctgtgcagtctaattttgagctgcctctttgtagtcttaaaaggcaggagcttcgtgttgtgggtctgctaacccgtacgtttccgtgggcaagtcgtgtgtactcctcgccatg

SEQ ID NO: 802 - DNA, 77 bp, Homo sapiens
cgacctcttcaagatggcgggcgccggagactagcttccgcttccggtgtgagcggcccggccgggggggcaagatg

SEQ ID NO: 803 - DNA, 72 bp, Homo sapiens
ttttctttatggcgtgggagaggccacagcccggactccatcgactcccccggctcttagactaaaatcatg

SEQ ID NO: 804 - DNA, 131 bp, Homo sapiens
ctccctctttcttcccctctggggaagctcagtgctggacttccgaagaccttttacgacattgagtctcggagttggtctcagcgccggatccacttttcggcaaagtgacgtggacgtcaacagcaatg

SEQ ID NO: 805 - DNA, 800 bp, Homo sapiens
gctcctctctggggagtggagggtgttcagttattaatgaccgctgagcaggcagcaccatgtcagtgtgacaactgatcgggtgaacgatgcaccactaaccaccatggaaacaaggaaaaataaagccagctcacaggatctctcttcactggattgagagcctcagcctgccgactgagaaaaagagttccaggaaaaagaaggaatcccggctgcagcctcctgccttcctttatattttaaaatagagagataagattgcgtgcatgtgtgcatatctatagtatatattttgtacactttgttacacagacacacaaatgcacctatttataccgggcaagaacacaaccatgtgattatctcaaccaaggaactgaggaatccagcacgcaaggacatcggaggtgggctagcactgaaactgcttttcaagcatcatgctgctattcctgcaaatactgaagaagcatgggatttaaatattttacttctaaataaatgaattactcaatctcctatgaccatctatacatactccaccttcaaaaagtacatcaatattatatcattaaggaaatagtaaccttctcttctccaatatgcatgacatttttggacaatgcaattgtggcactggcacttatttcagtgaagaaaaactttgtggttctatggcattcatcatttgacaaatgcaagcatcttccttatcaatcagctcctattgaacttactagcactgactgtggaatccttaagggcccattacatttctgaagaagaaagctaagatg

SEQ ID NO: 806 - DNA, 162 bp, Homo sapiens
ggccctctctccgcgcggagccgagccggaactgcggcagtctctccctgccaggctcttcatccaaggtttctgtggatcccttctgaagttctatctgaaaattgcgcttaagtgaattttctgttagaagaacttggttgctactttcttgtcaagatg

SEQ ID NO: 807 - DNA, 116 bp, Homo sapiens
ccgcccctttaacctttagggtgcgcgggtgcagtatatctcgcgctctctcccctttccccctcccctttccccaccccgggcgctcaggttggtctggaccggaagcgaagatg

SEQ ID NO: 808 - DNA, 29 bp, Homo sapiens
cttcctctagaacccgacccaccaccatg

SEQ ID NO: 809 - DNA, 104 bp, Homo sapiens
gctcctcttttccagtcctccactgccggggctgggcccggccgcgggaaggaccgaaggggatacagcgtgtccctgcggcggctgcaagaggactaagcatg

SEQ ID NO: 810 - DNA, 383 bp, Homo sapiens
cctcctccttcctcctcctcctcctccttcttctcctccttctcggccgggaggaggcagggctggatccctcagccgccgccgctcctcctcctggcaggccggccgcggagtcagctgacgccggcgctccagcctcgcctccccgcgccgcgctctgcgctccccgaaagtggctgcaagccggccgcccactgtcagggttggggggacagagaaagtgatgtgcgccttctaaagcctcgcccagcgccgccgaagcagcttcacctctccaactttctcccaccgactgcttgtcttgaccctgccctccaccctccccagagccacttcgggtgcgcgctcttgggtaaagggggggtcaccggctgtctgggatg

SEQ ID NO: 811 - DNA, 175 bp, Homo sapiens
tctcctccatcgcctgcagtaagggcggccgcggcgagcctttgaggggaacgacttgtcggagccctaaccaggggtatctctgagcctggtgggatccccggagcgtcacatcactttccgatcacttcaaagtggttaaaaactaatatttatatgacagaagaaaaagatg

SEQ ID NO: 812 - DNA, 367 bp, Homo sapiens
tggccttttgccctagggagcgagtgcggagcgagtgggagcgagacggccctgagtggaagtgtctggctccccgtagaggcccttctgtacgccccgccgcccatgagctcgttctcacgcgaacagcgccgtcgttaggctggctctgtagcctcggcttaccccgggacaggcccacgcctcgccagggagggggcagcccgtcgaggcgcctccctagtcagcgtcggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatg

SEQ ID NO: 813 - DNA, 25 bp, Homo sapiens
cgctcttcctcaggcggcggccatg

SEQ ID NO: 814 - DNA, 91 bp, Homo sapiens
cggtcttcctcctcgtcctgccgcagggccagaacccctgacggtattcagctgcgcgtaagtctggccggtgccatctgtctccgcaatg

SEQ ID NO: 815 - DNA, 73 bp, Homo sapiens
cggtctccttcggcaaccccggccgaacggccacccagaggctgtgctgagctggcgcagcggcagcagcatg

SEQ ID NO: 816 - DNA, 170 bp, Homo sapiens
gtttctttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgggcatg

SEQ ID NO: 817 - DNA, 71 bp, Homo sapiens
gattctttttggatagggttgacgttcgtggatagactcatatctgtgaccagtgtccgccaccgcggatg

SEQ ID NO: 818 - DNA, 54 bp, Homo sapiens
ccccctccctgcccacctcctgcagcctcctgcgccccgccgagctggcggatg

SEQ ID NO: 819 - DNA, 96 bp, Homo sapiens
cgtcctcccaagatggcggagacagagtgaagaaactgtgttccccccttgggttgctatcgatcaagggtaaaattccattctgatatcaaaatg

SEQ ID NO: 820 - DNA, 342 bp, Homo sapiens
gcttctttttctggtagaaggcggggttctcctcgtacgctgcggagtctctgcggggtgtagaccggaatcctgctgacgggcagagtggatcagggagggagggtcgagacacggtggctgcaggtctgagacaaggctgctccgaggtagtagctctcttgcctggaggtggccattcattcctggagtgctgctgaggagcgagggcccatctggggtctctggaagtcggtgcccaggcctgaaggatagccccccttgcgcttccctgggctgcggccggccttctcagaacgaagggcgtccttccaccccgcggcgcaggtgaccgctgccatg

SEQ ID NO: 821 - DNA, 134 bp, Homo sapiens
aggcctctccaagcccctaccgcacaggctcatagccccaagcccggaggaggtggctacattgtgtctattgtatcccttggctggtgtatttgtacatctctcgggacgtgaaattgacagtgaaaagtatg

SEQ ID NO: 822 - DNA, 245 bp, Homo sapiens
cttcctctggcggcgtccggccgcttctcctctgctcctcgaagaaggccagggcggcgctgccgcaagttttgacattttcgcagcggagacgcgcgcgggcactctcgggccgacggctgcggcggcggccgaccctccagagccccttagtcgcgccccggccctcccgctgcccggagtccggcggccacgaggcccagccgcgtcctcccgcgcttgctcgcccggcggccgcagccatg

SEQ ID NO: 823 - DNA, 362 bp, Homo sapiens
cgtccttctcgcgcctcgctctggccctgcaggttgtgtttccgcctctaccccgcctccattccgttgctctctcagtctcagacccgggctctcggtccgccgcttcaggtcttggcgcagcctcagagagttggcgcggctctgtgttgaccaaacctagtggatgcagttagcgccggagcccggccccgcccgtcaccagggttattcccgccttctaggtttgccaggactgccggccctgcagctgccttctgccccaggtttttggctactgatgttacaaacaataaaatattggagcatagagttgaagaacagactcaaaccaggtttttatttaattagttaaaaatatg

SEQ ID NO: 824 - DNA, 298 bp, Homo sapiens
tttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatg

SEQ ID NO: 825 - DNA, 357 bp, Homo sapiens
gttcctttttgggttagctttggcagtattgagttttacttcctcctctttttagtggaagacagaccataatcccagtgtgagtgaaattgattgtttcatttattaccgttttggctgggggttagttccgacaccttcacagttgaagagcaggcagaaggagttgtgaagacaggacaatcttcttggggatgctggtcctggaagccagcgggcctcgctctgtctttggcctcattgaccccaggttctctggttaaaactgaaagcctactactggcctggtgcccatcaatccattgatccttgaggctgtgcccctggggcacccacctggcagggcctaccaccatg

SEQ ID NO: 826 - DNA, 118 bp, Homo sapiens
gcttctcttccgctccgggtcggctccgtttccctttccgggcgggcaggcggcggaccccagtgtctttatccctcttttgcacagtcagcttctgcagctctcccgggctagcatg

SEQ ID NO: 827 - DNA, 62 bp, Homo sapiens
cgacctcttggctccgctagtgcccggcgcgccgccgccagtgctgcgggctccgggcaatg

SEQ ID NO: 828 - DNA, 879 bp, Homo sapiens
ctttctctcaggaaactccactcccaactgacaggtgctatttccagccagtcctatgctgttgcaaatagtgagtccatgaatgccctctgccgtgtgcattacttattttcatcagcagatcttcgtaacacactcctggaagtgggatgacggggtcaaaaggcgaatccatacataagttaaatagatattgctcaattctcttccacggggttcagaccattttggatttctacgagcaatgaagacagtgctattcctctacaccctggccggccaactgagcgtggttaaacgtggggagggaggagggtgaggttaccaacctgatggttgagaaagggcctccgcccagcgcgcccttcctccacccccacccgagagacagctgaactccggccgggacgcgcgtgttgccagtccagccctgcaccgcgtcccctgagggcgggctgcaggcggccgggaagccttgcacaaccggcccaaaagaggaagcccagaaagtgctgaagtaaacactttgggagaccgttgcaacataaagcggcctctcagtctttggtggaaccatcactaggccccaatcccttagtccctcttgcgtcgaggctgcaaaatggttccattcgccaggagacgctcctgagagaagggcgcgcgcggcacaggggccttccttgcacctcggagcaaagcagctcggatagcgccacacgtctgcgcgctgcgtgggaagggcagggctgacagcacttcctccccggggcagcgacctggagcccgggtgcggcagtctgcaccgcgcgtcgctttcccggccggagtctcgccgccttcccgcgccccgcagcgccccgcagagcagtcgagatg

SEQ ID NO: 829 - DNA, 77 bp, Homo sapiens
ccttccctcttcactgtgagctcagagcagcaggacaaagtgctcgggacaaggacatagggctgagagtagccatg

SEQ ID NO: 830 - DNA, 77 bp, Homo sapiens
acctcctttccctttcggattcccgacgctgtggttgctgtaaggggtcctccctgcgccacacggccgtcgccatg

SEQ ID NO: 831 - DNA, 76 bp, Homo sapiens
ttttcttttattcttgtctgttctgcctcactcccgagctctactgactcccaacagagcgcccaagaagaaaatg

SEQ ID NO: 832 - DNA, 46 bp, Homo sapiens
cctcctctactatctcggtatcaccaaacccttgccggctcttatg

SEQ ID NO: 833 - DNA, 350 bp, Homo sapiens
ctgcctcttatgaagcaatactagagaggaaaaacaaaacccattcctttaagaaagattccgcctcctctcataagcaagcgcctaatggtaattgtagagtttactaagtcaaacacttactactcagcattgagagaagctgctgctgctaatgctgctgctgctgctgccgccgccgccgctgctgctgctgctgttggtctgaggctgcagtaggtttctgtgcagcattgcagaatccacacctagagaacagaagacacagacacgtacgtctactacccttgttagaaggaagctttggatcttcggtggataacaagagtaatccacagacttaaaacatg

SEQ ID NO: 834 - DNA, 199 bp, Homo sapiens
agcccttttggatctaatgcgcagaggaggttggcccagagctcccgggctcccccaaggctgaactccgtccaaggtgcccgcaggctccctgcccgccttccccatgccagcccgcagctaggggcaggggcagcggcggctggggttgggggtgggtggggagcttttggggaggacaggtcgcagcttggctatg

SEQ ID NO: 835 - DNA, 279 bp, Homo sapiens
ttatctttttgcctagcgactgacaacaggctggttgcttggcgtggaatcctaaagtggcctggctttgagactggagtgagaccccagccctaggctggggttctttccattatagaggagacggattcagaagggctacagaccaaggttgttgaaaaccagacatatgatgagcgtctagagattaacgactccgaagaggttgcaagtatttatactccaaccccaagacaccaaggacttcctcgttctgcccatcttcctaacaaggctatg

SEQ ID NO: 836 - DNA, 1573 bp, Homo sapiens
cccccttttcgggaggagggaggcagggacttgcaggcaagagttgcacctggtctaggaacctgcagagaaaagaactctggggtaagtagtgttctggcactggcacggaaaggggtaaagggtggggggcatgagagggacgaaatggagagggcagggaatgaattatgcaaaaaaatctccaatatttcgcagcggagggagagcacagcacagcactcccaggatgagtcctgcctgggtctcccgcgccgaacccgcagcacgaagttctttttaagaagagaaactcgaaaatcctggagggtaacagaggcagccagggcggggcggagtgcggaggcggctgccagggactggggccgaggcggcggccaaggtggcctgaagctgtgacacccagcctcctcctcctcctcctcatggccgcgctcagcctcacctccccgcccgggcctcctgcctccgcccccgggtgccgggctgcggagctgacgctgggacgcccggcggcggcgaggacgctcacctggccaagcctccttctcctcctccccctcccgcccccacctgtcctcctcctctctgagttgggaagcgtagggatccgtaggcgaggaaataacgacccctgcagttgtattgcggaaaatctcgacagcggcgctagttgcgggcgatggaagccaggcaactgggggttctggggagttcaggaaaatagcagaggagcaggaagggcgcgcgcgacctggagagtctgtgtgcccccaccgcgccccagtccccggggcccagcccttcccctcggcgccctggacgcactgccggaacccggctgagaggctgcaggctgcgcgcggacctggggagcagggagggtcggcggaggctgccggcggctggcggtttcgggcaataatccctgcctctctttctctgtgtgtctgctgtgtctgctccttccccgccccccggaagcaggagaagaactgccccggagcgcagcagccaccctccgaccatgccccggtgaggggggcggacttcgagggcaacttgccgcggactgcctgggcttagccagcgagctacgcgctcccgggagcccggaattgcacggcgcagcccggcggggggctatcgtctatgtcttcttggggcgccagacgaatcggggtctcgtttttgctggaagagcccagtgttggtggcttcaggtggctgctgccgccgccgccgccgccgccgctgctagtgcggtttccgccgctggtgcgaagagaagagacacgcgagcggggagacctccaaggcagcgaggcatcggacatgtgtcagcacatctggggcgcacatccgtcgagcccgaggggagatttgccggaacaattcaaactgcgatattgatcttgggggtgactgtccctggccggctgtcgggtgggagtgcgagtgtgcactcgctcggaagtgtgtgcgagtgtgtatgtgtgtgtgccgtgtcgggctccccccttccccccgttttcccgtcgagtgatgcacttggaatgagaatcagaggatg

SEQ ID NO: 837 - DNA, 76 bp, Homo sapiens
cctcctccctgtaacatgccatagtgcgcctgcgaccacacggccggggcgctagcgttcgccttcagccaccatg

SEQ ID NO: 838 - DNA, 38 bp, Homo sapiens
gttccttctactctggcaccactctccaggctgccatg

SEQ ID NO: 839 - DNA, 36 bp, Homo sapiens
ccgtcttcccttcccgcgttccccgggagaaacatg

SEQ ID NO: 840 - DNA, 35 bp, Homo sapiens
cctcctttccgcttccggtgtcccctacagtcatg

SEQ ID NO: 841 - DNA, 76 bp, Homo sapiens
gctcctcctgctggctggggattttccagcctgggcgctgacgccgcggacctccctgcgaccgtcgcggaccatg

SEQ ID NO: 842 - DNA, 130 bp, Homo sapiens
cctcctctcgcgagaggcgcaaggcgtggagtcgacggctggagagaagccgggagcgagcccaggcggcagtcttgattcccttttggccagcagtttttaggtctgtcagtactgcactgcaagaatg

SEQ ID NO: 843 - DNA, 113 bp, Homo sapiens
taccctccttccccattttctgtggtccaactaccctcggcgatcccaggcttggcggggcaccgcctggcctctcccgttcctttaggctgccgccgctgcctgccgccatg

SEQ ID NO: 844 - DNA, 174 bp, Homo sapiens
agccctcccttccgcgcgcttactttgtttataacttgaaaaatcctctccgtctcccttccctgcctcctttcctttccctttcctctgccagtacaactagacccggcgtctggcgtccccggtgcccagcattctgcggggcaggcggattaattggaattcttcaaaatg

SEQ ID NO: 845 - DNA, 185 bp, Homo sapiens
cctccttccggctgggcaaggggccgcggggagcagctcgggactgaaccgagaggtgccgaaggaaccggcgggccgcttgatcccgctgcagacgtaggagatgcctgggacaaggaggccaccttctcagggcaaaagaaaaagaaggtgacaggcgttgagaccaccgaagggaacccatg

SEQ ID NO: 846 - DNA, 125 bp, Homo sapiens
agttctctctgggaacatctggtgggtactacaggccctattccaggccctatggcctgtggaacctcaccacgggggggagggctgggccagacggagacatcacctgtggtgtcagccccatg

SEQ ID NO: 847 - DNA, 82 bp, Homo sapiens
cctccttcgcgccggcccttccgcgggtgatcagctggtctgcgctcccctgacgtgggctggggcacgtcaccgccgaatg

SEQ ID NO: 848 - DNA, 153 bp, Homo sapiens
gggtctcttccggagtcttttcctggacggggtccctgcggtgggtgtgtttcggcctggcctgggcaggcgcttgtgctgccagggcgccgggcccggggaggccggggtctcgggtggccgccggcccaggcgctggacggcagcaggatg

SEQ ID NO: 849 - DNA, 16 bp, Homo sapiens
ttttctttccaaaatg

SEQ ID NO: 850 - DNA, 54 bp, Homo sapiens
ggttcttcactcgcgactgacggagctgcggtggcgtctccacacgcaaccatg

SEQ ID NO: 851 - DNA, 289 bp, Homo sapiens
ccttcttcctcttgttcctcctcctgcctctcttcgcttcgcctgcaaacgcggtgggggctgctcggcggtcaggagcaggttaccctccgtctgcatgcccaccatcaaggtatgaggatggtagaagctctcgtcgaaccagatggatgaagaccactaacggcttttgtttcctctggtaacagcaagagacagagcgacatgagagattggaccgcgggctgcactggagaatttactggtaggataattcatccctaaagagattgaagtgagcttcagaatg

SEQ ID NO: 852 - DNA, 151 bp, Homo sapiens
cggcctccgcccctgcagccgcgggcacgcggaggggctcctggctgcccgcacctgcacccgcgcgtcggcggcgccgaagccccgctccccgcctgcgcgtctgtctcgtccgcatctccgcggcctcctgctccacgacgtgaccatg

SEQ ID NO: 853 - DNA, 113 bp, Homo sapiens
ttttcttctcgggctgcaaacaaagggaagcctgcaacaagttaagctgaagaccgaagcaagagctggttcaggtggcagccacagcagcctcagggacctcagcaactatg

SEQ ID NO: 854 - DNA, 198 bp, Homo sapiens
ctgtctctttaaggtgcccgaggctcgcgggcgctgcgctgaggggacggcgggaggcgcggcctggcctcgcactcaaagccgccgcagcgcgccccgggctcggccgacccggcggggatctaggggtgggcgacttcgcgggaccgtggcgcatgtttcctgggagttactgatcatcttctttgaagaaacatg

SEQ ID NO: 855 - DNA, 313 bp, Homo sapiens
gtcccctttgtgaggcccgggatgggaggtgcccggttcccccagggacagcttcaagcggtagggacagacatctgaggacccagcctcagggatgctgtccccgggcttccaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatg

SEQ ID NO: 856 - DNA, 115 bp, Homo sapiens
gctcctcctgtcttgtctcagcggctgccaacagatcatgagccatcagctcctctggggccagctataggacaacagaactctcaccaaaggaccagacacagtgggcaccatg

SEQ ID NO: 857 - DNA, 81 bp, Homo sapiens; identical to SEQ ID NO: 756

SEQ ID NO: 858 - DNA, 24 bp, Homo sapiens
ctgtctttacccagagctaccatg

SEQ ID NO: 859 - DNA, 648 bp, Homo sapiens
ctctctttttcttgcagaaccgtctctctcccttctctgtctcttagcacagagctcttattcagccactagcttggcccttcctgcttcaattgtaatgcttgttctgcccgtccacagactattggcggcagaaacaacgaatttcctccaaactaggcggtgttggtggctcttgcattcctctggatgaggaaatctagttggggggttccagaaggggaaggctcctgggctttcaatacatcctcctgaatcatacctcgtttcgggttccctagaaaaatctggacgtgtaaaaagaactcttaacggccgatgcagctcttccaaagctaaggctgccttggagttttcataagaaattgtccctggaggtgttggatgatcacagcttccttggagcattgcagttgctggaatccagtttcaggattaagggagggctgcctccttgcaatgggctgccaagaaaacggctgtgcttgttcttaacctcaggctctgtctgtgatcagtctgagagtctctcccaggtctactgctccctggaaagccctatctctctgcaggctcgcctctgggctttgtctccttggagccacatcactgggacagctgtggatgtggatgcagatttgaaccatg

SEQ ID NO: 860 - DNA, 144 bp, Homo sapiens
ccgcctcctcgctgcgggaagggtcctgggccccgggcggcggtcgccaggtctcagggccgggggtacccgagtctcgtttcctctcagtccatccacccttcatggggccagagccctctctccagaatctgagcagcaatg

SEQ ID NO: 861 - DNA, 49 bp, Homo sapiens
ctgtctccatcttgtctgtatccgctgctcttgtgacgttgtggagatg

SEQ ID NO: 862 - DNA, 87 bp, Homo sapiens
cctcccctttttttccgccttctgccagcagaagcagcagccgcagcacctgagccgctactgccgctcactcaggacaacgctatg

SEQ ID NO: 863 - DNA, 161 bp, Homo sapiens
ggacctccctctttgcctcctccctgttccaggagctggtgccctgggctctgcgctgttgttttcagcgctccgaaagccggcgcttgagatccaggcaagtgaatccagccaggcagttttcccttcagcacctcggacagaacacgcagtaaaaaatg

SEQ ID NO: 864 - DNA, 187 bp, Homo sapiens
cttccttctggagctgggtcctgactagggaccgcctgggtgaggtgaggacctggtggccgcagttgtggcactgtgcgcaggcgctgaactgaccggacggagcgggcggctgtggcctcgccagctggtttaaaaatatccttttttgctgaaggaacacatttgctggtatagtttcagaatg

SEQ ID NO: 865 - DNA, 388 bp, Homo sapiens
ctatcctttcctctcagtcctgccatctagctgccttgggtctcgcgctccgcagagcgttccgacactctccggcctcgttctgccgcctccgcgcgctctccccgtgcggccaccgcgccccccaagcttgcctccttcttgccggacttggggccgcgcgccctgactccttcccctcccgcggacccgcgcactcccggcgcggcctctcccccacgcaggccaccgtgcactctgtggcctccccctccttccccgctctcctcgcgcttctctggctccctagctgtcgcgctctcctcggcgagcgcgctcccggcccgcgcgctccgggctccggtttctcccggctcctgtcagtgcggtgactgcgctgggaaacatg

SEQ ID NO: 866 - DNA, 488 bp, Homo sapiens
ccttctcctgagagtcggagccacagccagagccctgcccaggccgagccggagctgcagcccgagcgcggtggtgccctcagccccgtcctcttgtcctcctcagcctcggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaaggatctggtactgttctggagtggcctgtagcagacactgaaccaccagccagctgcatttgttgtcctggaagtcattgccaactctgccagtcacactggggtccccagagaagtcaagatctgccggaggcgctgggcaatgaccccgggactccaggccagaggggtctgaagctgtttgggaaagcagcgggactccttgggaagatg

SEQ ID NO: 867 - DNA, 191 bp, Homo sapiens
ctgcctttttcaccacctctaatttcagcttcagcagttgcttggaactttggttctggcagcagcagcaacatcattaccgctagcggcagttttgtgccgaggcacctacacacctcccgtcctctctgccagatcgcgggcctgtcggtgtctgctcctacacgccaacgccggtgggcaggaccatg

SEQ ID NO: 868 - DNA, 61 bp, Homo sapiens
cgccctttcaccccggacgtgggcgggagaggaagcggctggtgatgctggaacaaacatg

SEQ ID NO: 869 - DNA, 99 bp, Homo sapiens
cgctctttctccgacagctgccgggggtgccctgcaagctgttccgcgcgtcctgcccgtctgtccccgcgggtcgtcgcccgccacagccgcgccatg

SEQ ID NO: 870 - DNA, 90 bp, Homo sapiens
cgctcttttgtttcttgctgcagcaacgcgagtgggagcaccaggatctcgggctcggaacgagactgcacggattgttttaagaaaatg

SEQ ID NO: 871 - DNA, 168 bp, Homo sapiens
agacccttttcagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatg

SEQ ID NO: 872 - DNA, 92 bp, Homo sapiens
gggtcctttttcctctcttcagcgtggggcgcccacaatttgcgcgctctctttctgctgctccccagctctcggatacagccgacaccatg

SEQ ID NO: 873 - DNA, 79 bp, Homo sapiens
ggctctctccttgtcagtcggcgccgcgtgcgggctggtggctctgtggcagcggcggcggcaggactccggcactatg

SEQ ID NO: 874 - DNA, 102 bp, Homo sapiens
ggctctttccgctatctgccgcttgtccaccggaagcgagttgcgacacggcaggttcccgcccggaagaagcgaccaaagcgcctgaggaccggcaacatg

SEQ ID NO: 875 - DNA, 256 bp, Homo sapiens
gatccctttcccagtcctgcttcccagtgcctcgggccagggaatcctggcctccgcctgcggagccggcggaacccgcttcccgcctccacggggcagcgccagcggcctggtcctttcaccggcagctccgtgccgacgctctcaccgctcttcctatcgccgggagtggcgggccgaccagggggcggccgggctaccgtccgccattcccgtgtctctgcgcccgcgggggccgcccgagccggccaccatg

SEQ ID NO: 876 - DNA, 193 bp, Homo sapiens
ccgccttttccagttccaggtgtgcagaagtgtcctctccccacgcgcggcgggctgcacttggtcgctggctccgagatcgcgcggggccgccggaagcccaagacggtaccgggggccgcagccgcagccggcgccgccctccgccctccccaacagcaggccgagtcccgtagcatccggtagggaaatg

SEQ ID NO: 877 - DNA, 389 bp, Homo sapiens
agctctttccgggggcccggggaactactctccttgcctcgctctgtctccttcgaagtgctctgcgcgaggttcagagcggccgccgcctccaaagggacggttttctagagctccgacgcctctcggtgcccctctgctccggcccttgccctttgacctcgctctcgcggcagggtgagaggtcgggtggccatcttgtggcggcggcgcgggcggctgttactgcggagacccatcccctcccccttctcgcacccctggcagtctgtcagtcggtaaaaagtcccgcagcctgtcaggtgaggccccggcctcgtgccgtcgctcttcccgccgcactgggcggcccaggccgctccctgccgggcctcactgccgccaccatg

SEQ ID NO: 878 - DNA, 274 bp, Homo sapiens
ctatctttctagacaaggcagttgaggaggagggagcgcttgagggggactggcctggcgtgcactccgcacctcggggacattattgcgcgtggaacggctgcttttggaaggcacaacttcctgaatggaccatgactcccaccaaagatccctgtctctgattcaccaaacagcttcaaccctgaaaccaggacgagaagttgacaacatctgagtggacagctaattgacctaagacttcagaccagactattgcccagaagaaaagatg

SEQ ID NO: 879 - DNA, 513 bp, Homo sapiens
gggccttttatctcggtgctgccgggggaggcgggaggaggagacaccaggggtggccctgagcgccggcgacacctttcctggactataaattgagcacctgggatgggtagggggccaacgcagtcaccgccgtccgcagtcacagtccagccactgaccgcagcagcgcccttgcgtagcagccgcttgcagcgagaacactgaattgccaacgagcaggagagtctcaaggcgcaagaggaggccagggctcgacccacagagcaccctcagccatcgcgagtttccgggcgccaaagccaggagaagccgcccatcccgcagggccggtctgccagcgagacgagagttggcgagggcggaggagtgccgggaatcccgccacaccggctatagccaggcccccagcgcgggccttggagagcgcgtgaaggcgggcatccccttgacccggccgaccatccccgtgcccctgcgtccctgcgctccaacgtccgcgcggccaccatg

SEQ ID NO: 880 - DNA, 137 bp, Homo sapiens
ctctccctttgtcattctagctgcctgctgcctccgcagcgtccccccagctctccctgtgctaactgcctgcaccttggacagagcgggtgcgcaaatcagaaggattagttgggacctgccttggcgaccccatg

SEQ ID NO: 881 - DNA, 60 bp, Homo sapiens
cttcctcttttctaagcttgtctcttaaaacccactggacgttggcacagtgctgggatg

SEQ ID NO: 882 - DNA, 501 bp, Homo sapiens
ctttctctttttgtttggcttctaacgcgttgggactgagtcgccgccgtgagctccccgaagactgcacaaactaccgcgggctcctccgccccgtctgcgattcggaagccggcctgggggtcgcgtcgggagccctggcgctgcagctccgcaccttagcagcccgggtactcatccagatccacgccggggacacacacacagagtaactaaaagtgcggcgattctgcacatcgccgactgctttggggtaacaaaaagacccgagttgcctgccgaccgaggacccccgggagccgggctcggagcagacgaggtatccggcggcgcccatttgggggcttctaactctttctccacgcagcccctcttctgtcccctcccctctcgctcccttttaaaatcagtggcaccgaggcgcctgcagccgcactcgccagcgactcatctctccagcgggtttttttttgtttgtcgtgtgcgatcctcacactcatg

SEQ ID NO: 883 - DNA, 424 bp, Homo sapiens
cgtcctctccgggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatg

SEQ ID NO: 884 - DNA, 22 bp, Homo sapiens
ggctctccccgcgtccaagatg

SEQ ID NO: 885 - DNA, 153 bp, Homo sapiens
gcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatg

SEQ ID NO: 886 - DNA, 304 bp, Homo sapiens
ctttctctttccctttgcaattgccttgggtcctgccgcacagagcggcctgtctttatcagaggtccctctgccagggggagggccccagagaaaaccagaaagagggtgagagactgaggaagataaagcgtcccagggcctcctacaccagcgcctgagcaggaagcgggaggggccatgactacgaggccctgggaggtcactttagggagggctgtcctaaaaccagaagcttggagcagaaagtgaaaccctggtgctccagacaaagatcttagtcgggactagccggccaaggatg

SEQ ID NO: 887 - DNA, 251 bp, Homo sapiens
gctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatg

SEQ ID NO: 888 - DNA, 71 bp, Homo sapiens
cctccttctcctcccagtgccacagagccgaagcccgagctgccgccgcagccacagccgagggcactatg

SEQ ID NO: 889 - DNA, 20 bp, Homo sapiens
tgaccttttaccccaacatg

SEQ ID NO: 890 - DNA, 22 bp, Homo sapiens
ccgccttccccggcgcgccatg

SEQ ID NO: 891 - DNA, 256 bp, Homo sapiens
agttctttgtagtgcctccctcagactctaacacactcagcctggccccctcctcctattgcaaccccctcccccgctcctcccggccaggccagctcagtcttcccagcccccattccacgtggaccagccagggcgggggtagggaaagaggacaggaagagggggagccagttctgggaggcggggggaaggaggttggtggcgactccctcgctcgccctcactgccggcggtcccaactccaggcaccatg

SEQ ID NO: 892 - DNA, 148 bp, Homo sapiens
cctcctcccgttccagctgccgctgccgcttcctgggctgagtccgcccgcggtcccggcggcgccaggtgcgttcactctgcccggctccagccagcgtccgccgccgccgtagctgccccaggctccccgccccgctgccgagatg

SEQ ID NO: 893 - DNA, 429 bp, Homo sapiens
cctcctttttgcacacacacgaatacaaagagccatacgaccttcggatgccggaaggtccttctgaatcccttccctgttccttaggttgcactagtcgggggttccatgctggggggcagaaggaatgctctctaccgtctgaaaccgttcatcaggaaggccttgatttgtgatgtgctaggagagcacaggatctgcaaatagaaggcacctgtctcccttctgcaggccgaggagaggccgccatggactgtgtgcttcttcatggcttgtttactcttctttcacagaccctacagcttggggcctgggctcctctgaccatcctcattgagaaaggaaagtgagtccagagaagttgatgcttcctacctgttggagcggcccagcagtgtaagcgtggttgttactgccccatccgccatg

SEQ ID NO: 894 - DNA, 174 bp, Homo sapiens
cgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatg

SEQ ID NO: 895 - DNA, 151 bp, Homo sapiens
cggcctctcttcctcagtgcgggcggagaagcgaaagcggatcgtcctcggctgccgccgccttctccgggactcgcgcgcccctccccgcgcgcccacccacccagtccggctggactgcggcagccgcgcggctcaccccggcaggatg

SEQ ID NO: 896 - DNA, 83 bp, Homo sapiens
ccgcctctggcgaatggctcgtctgtagtgcacgccgcgggcccagctgcgaccccggccccgcccccgggaccccggccatg

SEQ ID NO: 897 - DNA, 28 bp, Homo sapiens
cctcccttttcttttctgccgggtaatg

SEQ ID NO: 898 - DNA, 288 bp, Homo sapiens
cttcctcttttctgtctggcccgcggccccgctgcctgccctgctccaggctccacctgcgccgccgatcgcccgggtatcgcgggggcccaggccagctgagtccgttttccgcgccggggtggcgcccctccaaccgtcctaacgccgggccggcagcaaggagtgttcctgggacctcagagaccaggctcagagcctgacatccctgcgaggggacagcctcatccgcccaggccagtgggggtctctacaagtgcccaggctcaggtgcagcccccagcaatg

SEQ ID NO: 899 - DNA, 46 bp, Homo sapiens
ggtcctcctgggagtctcggaggggaccggctgtgcagacgccatg

SEQ ID NO: 900 - DNA, 153 bp, Homo sapiens
tcctctctatgcttggggaaggaacttcctgtaagcaaggcttgaggcttgctctcgccttcgtcagcagccctcctcaatcttctccaaactcccgtccccaggccacacagattctcctcaagagagccctataaggacattggtaaaatg

SEQ ID NO: 901 - DNA, 381 bp, Homo sapiens
attcccttccgcccccttctctaagctgcacagcctgaatagaagggctggtccagcggcggcggaggctggcgctgtcctgagagggagggctctgtgcggaagagtcagggcgacccttgggcgctggagtacgcttgggactggggctgcgagtgagcaccagcgattggttcggaagcggacatttggttcagaacgagcatttaactctgccagggatccgctgggctctgacgactgcggtagatccatggcttcctggacgttcacccgtagagtcatcctagcttaactcttgttccctggtctcagttcacaagcctcacctgtatcttcctggctcggaagataattgaaaccaagtctgacttctcaatg

SEQ ID NO: 902 - DNA, 35 bp, Homo sapiens
ctttctcttcccgacgcgtgagttaggccgtaatg

SEQ ID NO: 903 - DNA, 292 bp, Homo sapiens
ggccctctggcaagatggctgctgcggaggcgttggagcgcggaaatctggaaccgggatggcgacgtctacactgagtcggaggcgaaggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatg

SEQ ID NO: 904 - DNA, 123 bp, Homo sapiens
cggcctcttcgcttttgtggcggcgcccgcgctcgcaggccactctctgctgtcgcccgtcccgcgcgctcctccgacccgctccgctccgctccgctcggccccgcgccgcccgtcaacatg

SEQ ID NO: 905 - DNA, 108 bp, Homo sapiens
tcctctcttgactttgagcgtccggcggtcgcagagccaggaggcggaggcgcgcgggccagcctgggccccagcccacaccttcaccagggcccaggagccaccatg

SEQ ID NO: 906 - DNA, 29 bp, Homo sapiens
ggttcctctcggagcggagacggcaaatg

SEQ ID NO: 907 - DNA, 156 bp, Homo sapiens
ccccctctcgcgggaattatttgaacgttcgagcggtaaatactccctggggctgtcatagaagactactcggagagcgctgcctctgggttggcgggctggcaggctgtagccgagcgcgggcaggactcgtcccggcagggttccagagccatg

SEQ ID NO: 908 - DNA, 33 bp, Homo sapiens
tatcccctcccacggtctctagttcgcgttatg

SEQ ID NO: 909 - DNA, 275 bp, Homo sapiens
ctgcctctacagctgtgtgtaggcctgggggcgagggtcttcggaacgtagcgctggctgcggccccgcccgcctacccacccgcccgtccggcagccggctcccgccgcctccgcgctctgtctggggccagccacctggcgggccgctccggtgcgcctgcccgcgcttttcactgacaggcgctgttccccacagccagcgccgcccgccacgtcccagctctcggccaacggagctgcgcggcgggtgacctttccgagcccagcgcgatg

SEQ ID NO: 910 - DNA, 243 bp, Homo sapiens
ctaccctttcatctctgcaactccttcctccctgggcctcccttctggtgtgtctgtgggtctgtctaggtgggcttgggaaaggggaaggaaggggcgtctctttaggcagctcagactggacaagccttctttgaaaatggtcctttgaacacacgcctgctggtggttggtcagacagatgcgccagcgggagccccggggccccaaggggacagctatctctgcaggaccagtgcgatg

SEQ ID NO: 911 - DNA, 402 bp, Homo sapiens
cagccccttttccggctgagagctcatccacacttccaatcactttccggagtgcttcccctccctccggcccgtgctggtcccgacggcgggcctgggtctcgcgcgcgtattgctgggtaacgggccttctctcgcgtcggcccggcccctcctgcctcggctcgtccctccttccagaacgtcccgggctcctgccgagtcagaagaaatgggactccctccgcgacgtgcccggagcagctcccttcgctgtggaagcggcggtgtcttcgaagaaaccggaagcccgtggtgacccctggcgacccggtttgttttcggtccgtttccaaacactaaggaatcgaaactcggcggccttgggggcggccctacgtagcctggcttctggttgtcatg

SEQ ID NO: 912 - DNA, 107 bp, Homo sapiens
acgccttttccggcccgcagcgcggcctgggctcccgcgtgtttaaaagtgcgcttgtggctgctgctgtcttaactcctgtgcttggcggacagacaggcgagatg

SEQ ID NO: 913 - DNA, 65 bp, Homo sapiens
agtcctttctcgtcgctgctcggctcgcggcccgtggggtcggccccgccaccgttgccgccatg

SEQ ID NO: 914 - DNA, 312 bp, Homo sapiens
cggcctccgccgcacgcgctggcggactaagagtggctggcgaagcgagcggccggcgcgggcccctggcgggcgggcggtacagccccaagcctgagacccggacctgagcatcgcaggttcgagtcccgccccgcctggggcgaagccgggggtggcggcgacctcgcggcgttgcaccggctctgtgagcacctcccctctgagcacttcccttgtgacaggccacttcccttgtgacaggcccaggacgaggtggccaggcggcccccatggcgtccctggtctaggcggagaaccgcctgggcgatg

SEQ ID NO: 915 - DNA, 351 bp, Homo sapiens
ccctccctccacctcggagtctgcgcggcgcggccaggcccggccgaccgcgtctcggtcttcgcgtctgccagcctggctggcagtccgtctgtccatcccgccgcgccggggcagtctaggcggagcgggggctcaggcggcggcggcctcgacgcgagtgagtgtcgtggttggggtgctggacccagagtgcctaccctcgcctgcctgggcctcagtttccacatctgcacaatgggggtgaccatccctgccctgctggctgccaggagcggctgtgagtcttcaggcgtggatgcagcctgggggaagccatagggcgctttcacaggcctggccttcaccatg

SEQ ID NO: 916 - DNA, 27 bp, Homo sapiens
gaaccttttttcacctcgtctgaaatg

SEQ ID NO: 917 - DNA, 117 bp, Homo sapiens
cgccctcccacccgctcagacctggttgccagcccaacaggaagcggcccctcccggcttcggagccgccgccactcatctctgcccagctgctgccctccccaggaggcctccatg

SEQ ID NO: 918 - DNA, 254 bp, Homo sapiens
gctcctttaaggcagcgaacgggccaagagaagcgtgtttcgccccctccgacgccaccgaggtagcggcttcacctttaaggcggcgcgggggctgctgggaaggccggcgggatggaggcggcgggaccggctcgcgggtgcgggtccgggtgaagcgggaggcagccagagtcggagccgggcccgagcaccaggcgcaggcccggcgcccgcctgcccgcaccctcgtcctcacagacgccacagccatg

SEQ ID NO: 919 - DNA, 178 bp, Homo sapiens
acttcctttttctgcccactctggtaacttattgctctgctgggctctttcccttagggtctctggccctgttcttgccccagcatgacttttatcgggacgccgttgtggaagcctcacgcaggagccctgcccccgtggagaagatcccactggtgactccaaccctaccaccatg

SEQ ID NO: 920 - DNA, 648 bp, Homo sapiens
gctcctcccactgccgttgtgggtaacgcggacgtggaagaacctcgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggtctgcctgtagatctgctgtagggcttgtcaccattggaagcaaggtcctacttcagtggcagatctggtggccttggagtggctgaagaccaccaccctccacagggctgggcccatgcacagccatccttccctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaacatg

SEQ ID NO: 921 - DNA, 24 bp, Homo sapiens
aatcctttgcggtggttcaagatg

SEQ ID NO: 922 - DNA, 65 bp, Homo sapiens
ggtcctcccgtaggaaccggcggactcggttggcgttgtggggcagggggtggtggagcaagatg

SEQ ID NO: 923 - DNA, 907 bp, Homo sapiens
gggcctcctcgcctttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagcgtgcttatgcgcgaagagactgaactgaagacgctgcagactcagatagcaaaataataagcctacttcatgataagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatg

SEQ ID NO: 924 - DNA, 590 bp, Homo sapiens
ccgccttcccaccccccgcccttccactatggccgcttctgtgtggtgtggggagacgctggtcctccccgtcctcccatagcgcttattgcctcaccctcaccccctaggggccggatccaaaggcgctgcactccccaagccttggggcatcagccaggaaggtttcctacctcctaattcaggggcaggactcctcttttccccccacggggaaaagaggcagaaacttaggggtttccctcctttcttagggtcagacgctcttagggtccacttcttcaggggcggaagcctctcctacccttcccataggggcacaggcctttaccccactgtacttcggagccaacgcctttccctcagcactgccaccccagagtcaggacccagaggactgtgccttcgcccccaacgcaggcgcggccttttggagaggagggaggagtggagaggacaggggcccttgctctcccctccccaacttgttcctcttgccccccagtccctggcaatccagagatcccgatatctaggactgtccatccatccactccctgaccttttcccggctcctggctgcagccatg

SEQ ID NO: 925 - DNA, 396 bp, Homo sapiens
tctcctttcctcttctcagacccgggagcgtccgggacgcggagcccggagctggggcgacgaggcgattgcgggggcctgggctagctgctggctaccaatattctactttctgtctctatgaatgtgactaccctggttacctcatataatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatg

SEQ ID NO: 926 - DNA, 269 bp, Homo sapiens
ccgcccctttcacctcctggctccctcccgggcgatccgcgccccttgggtctcccctcccttccctccgtccgcgtctcctgcgccccctccctgcgctcgtcccgccgctcttcccgccgcccaacttttcctccaactcgcgctcgggagctggcgaggcggcggcggctcctcaggtcagtttgaaaaggaggatcgagctcactgtggagtatccatggagatgtggagccttgtcaccaacctctaactgcagaactgggatg

SEQ ID NO: 927 - DNA, 29 bp, Homo sapiens
ctccctcttccgctgccgccgtgggaatg

SEQ ID NO: 928 - DNA, 37 bp, Homo sapiens
cctccttctttcctgcctctgattccgggctgtcatg

SEQ ID NO: 929 - DNA, 31 bp, Homo sapiens
agtcctttgcgcggcacctggcgacaaaatg

SEQ ID NO: 930 - DNA, 1100 bp, Homo sapiens
ccctctcttctccaccagccaacgtccgggaaaaacgagtaagtacaggttccttctgccaatccccgccggccacagctaactttcccgcccggcccctttctgtcataattgaggtgtccacaaccagccaatcaggaacgcgagagtatcccgcgtttgctttcgctcgccgaggcgcgtatcagtcggaattttggggagccaaccgcgccgtctgtccctggcaagccagcggcggtttaaaggaggtggcgggaagcctgtgtgtgcttcaaatcgtcaccctcatggtcgctccggtaagtgctgcggggcagcattttctctgaggaggagcggggacgggcgagactggcataagcgtcttcgcgagggagcaaggcggcctgtgggtcggcctcaccccggcctccgacctgaagatcccagcatgcagcgcgggcgcggggcccgacggaagccgggagccggccggaagcagttcctgcgctctggcttctgggtcctgtcctgcgcgatcgcggggtcttagacagctcaactcgccgagatgacctgggcacctctgcgttgaatcggcaaatactgatcaagccgcatttattctgctctcaggaactctaagtctagcagagaagatgaggcggtagaagttcatcaatggcttggctggaggacaagcaaattgaggacattggcaacggagtgatcaaaatgatagatcatgaggcctaaaatgaataaggaaagaagagaagtggcagaggctgagaacagaaagagagggtggaggggctgtaaatcttgaagattagggtataatatgagtatatgggtaagaattggaagaattgtgtaggaggcagtagtcaaaaagtagaagcagtttggaagagtagttacaaatatcaagagccaggtggctaaaaggtggagctataggtcattgaagctcaagaaactgagtctctagggcattggttaagtcatctgtctagacttcaaagttgtctaggatgataattcagaagactgatctgtgccaaagtcacaggtttttcacgactgaaaacaacatagcaaaataagccaagatg

SEQ ID NO: 931 - DNA, 76 bp, Homo sapiens
cttcctttcacgctgtcgctgcccgtaggtggttgtggccactgtgcccggagggaggcggcggtggccagtaatg

SEQ ID NO: 932 - DNA, 73 bp, Homo sapiens
cggcctctgcgtgcacgcgcctgcgtgctcgcgctcgcggttctggcgctgccggaataatgctgacagcatg

SEQ ID NO: 933 - DNA, 168 bp, Homo sapiens
ccgccctttcctgtcgtgacttaacgcacgcaagcggctccagggtacgtccccgccacgcgcgctcgcaggatcggtgcgtggtgacgtttcgccggcgcgggcgccatcccggaagcgcgagcaaggccgccagatgtgcaggcagcggaggaggagaaagagatg

SEQ ID NO: 934 - DNA, 70 bp, Homo sapiens
acttctttcttgcccgccaagcccgcagccacccgggcgcggcgggactcctagacccggcgctgcgatg

SEQ ID NO: 935 - DNA, 289 bp, Homo sapiens
cgttccttttgtgacgccggctgtgagcgcctgagagtctttttgcctttcagagttaaggcctcactggcctgggaaaataattgctgccttttgcatccgcgttggctccgtccccaggatcttcccggttcagggacctggcgatttctgagtgttccggaatcccaataaccctgtttaaagaggaatggagattgccactgtccatttagattaatgaggtgtcctgaagtgatggtgacatcaatgaaaggagggttctgacacgttctcacctcgcgggatg

SEQ ID NO: 936 - DNA, 208 bp, Homo sapiens
caacccttttcttccgcacggttggaggaggtcggctggttatcgggagttggagggctgaggtcgggagggtggtgtgtacagagctctaggacaccaggccagtcgcgggttttgggccgaggcctgggttacaagcagcaagtgcgcggttggggccactgcgaggccgttttagaaaactgtttaaaacaaagagcaattgatg

SEQ ID NO: 937 - DNA, 225 bp, Homo sapiens
ccgcctcctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggcccccccaggatgcaatg

SEQ ID NO: 938 - DNA, 85 bp, Homo sapiens
cccccttccgcctgacgcgcccccggcggcggccgcgcagccctggctcctcgcgggctcgggcggcggctgcggcggggctatg

SEQ ID NO: 939 - DNA, 358 bp, Homo sapiens
ccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatg

SEQ ID NO: 940 - DNA, 284 bp, Homo sapiens
acgccccttttttgctcagccgtcagccccgtctccgtctgaagagtgcttctgccctcatttgcctctccctgtgaccccggccccctcagactccgctgcgtcgtctctcggccccgtccagccgttcctgactgctcttcgccggagtccgcttcccaaccccctttcgccagagcccgagagctccgtcggctctgcgtcctggcggattgtcagtggcttcgccccgaggagagctgactgccctgggctgctgcctccggcagagctgagccaaaatg

SEQ ID NO: 941 - DNA, 465 bp, Homo sapiens
ctcccttccccctctgtgggtcccgcgaggagactctcgggctttgaggtgagacctgaagttccgctggccggtagtgtagcaggaaagggcaggtcctcccgggtcgtgagccagtagcctcctggggtggcaaggtgtagagaggggggcgttgaaaggacacccgctacccggcctgctttctaggggtctctttggattgaggacatcagcagcagtggaagggattttactggagacctgtcactgtcagagccttaaaatatcaccgacggggccttaatgtcaccgaggtagagagaaaagggcagtagccctagagactattgcgacacagtgtgcccctcataagtttttccagggaggggttctgtactgagttgacgccccaggagctgagcaccaggctttgcatccttgggaactcagcaaacgtttgttcagccaattgcaggtagcatg

SEQ ID NO: 942 - DNA, 82 bp, Homo sapiens
tactcccttccctcaggccccaggaagttgcaagagtaccatttgtcgcacactcggggaccgcgggtggccggaggagatg

SEQ ID NO: 943 - DNA, 83 bp, Homo sapiens
gctcctccttcgcggcggtaccgcctctgtttctgcggcgattgaacagccgagctttgcggccgggatcgcggaaagtgatg

SEQ ID NO: 944 - DNA, 612 bp, Homo sapiens
atttcctctctgctgagagccagggaaggcgagctctgcgcacacgggcgtccctgcagcagccactctgctttccaggaccggccaactgccctggaggcatccacacaggggcccaggcagcacagaggagctgtgaacccgctccacaccggccaccctgcccggagcctggcactcacagcaggccggtgctaaggagtgtggcgcgggctcgactcccactgctgccggcctcccgagtgactctgttttccactgctgcaggcgagaagaggcacgcgcggcacaggccggcctccgcttcccgggaagacggcgcactcctggccctgggttcttgctgctgcccaccctctgctccctgggatgggccccgaggcgagcagcttcagcacaggcctggccctgctccaggtgcaggaaggaggataaggccgggccgagaggcggcacacctggaccatcccatgggcctccgcccgcgccgccccgaggatgagtggtgatgtcctctagccacccctagcagcgtcggctctccctggacgtgcggccgcggactgggacttggctttctccggataagcggcggcaccggcgtcagcgatg

SEQ ID NO: 945 - DNA, 67 bp, Homo sapiens
tcgtctttcccctcccatctcctcagatcggtggacgtgctcgcctccactcggggccaggtctatg

SEQ ID NO: 946 - DNA, 44 bp, Homo sapiens
cctccccttttcggcccagtagcggcggctcagttgctgccatg

SEQ ID NO: 947 - DNA, 98 bp, Homo sapiens
ccttctctttcggagttgttccgtgctcccacgtgcttccccttctccactggctgggatcccccgggctcggggcgcagtaataatttttcaccatg

SEQ ID NO: 948 - DNA, 81 bp, Homo sapiens
aaccctttgccttcggacttctccggggccagcagccgcccgaccaggggcccggggccacgggctcagccgacgaccatg

SEQ ID NO: 949 - DNA, 81 bp, Homo sapiens
cggcctttcctccgcgcccccgcgtccccagccggccgctccgagaggacccggaggaggcaggtggctttctagaagatg

SEQ ID NO: 950 - DNA, 26 bp, Homo sapiens
ccgccccttacggcgccggagagatg

SEQ ID NO: 951 - DNA, 297 bp, Homo sapiens
cctccctttttctacttccgaggctgcaaagtgcaacagcagactcttctgactcaggaaggccggtgctcctacccacttcctgttcctccatctccagcggacactgctctttcaagggcaggtctccagcccagctctctgaaaacattttgctgaaaatataagcaaacatcggccttgtcctccttgtgttcatacactgtggaagcttttctctgcctcctccgtgagagtgcgtggccgggagaccagaaacgtggtcctttctcttgcctgtgagctggtgcagagatg

SEQ ID NO: 952 - DNA, 64 bp, Homo sapiens
cttcctccggctggcagcacgactcgcgtagccgtgcgccgattgcctctcggcctgggcaatg

SEQ ID NO: 953 - DNA, 27 bp, Homo sapiens
aattcttttttccccaggcttgccatg

SEQ ID NO: 954 - DNA, 254 bp, Homo sapiens
acttccctttttccggtccgccggattatgaatgacggccggcgcgagtattttccacataaggtggctgtcgtttttctcctggcgtctgtggaggcgagtggtctgcgggcagcagctcccagaggcagccttggaattccagctcggactgggcgggaaggcgcaggcggcccaggtcgccgacacgctcacgcaccctccctgcctggccgcgcctctgcgaccaggtgacccaatgaaagaagaaaatg

SEQ ID NO: 955 - DNA, 311 bp, Homo sapiens
actcctttttctttccaaacagggaaaagtgttccacgaagcggtagcgcctttccgcctcgcgttttcctccctgaccctggtcccggctcccgtccgggcgccagctggtggggcgagcgccgggagcccatctgcccccaggggcacggggcgcggggccggctcccgcccggcacatggctgcagccacctcgcgcgcaccccgaggcgccgcgcccagctcgcccgaggtccgtcggaggcgcccggccgccccggagccaagcagcagctgagcggggaagcgcccgcgtccggggatcgggatg

SEQ ID NO: 956 - DNA, 118 bp, Homo sapiens
cctcctcttgcggtggggggaaagcggcctcttactctaggcctttcggtttgcgcgagcgggcaggaaagcgtgcgtgcggctaagagagtgggcgctctcgcggccgctgacgatg

SEQ ID NO: 957 - DNA, 299 bp, Homo sapiens
cctccttcttccactccccgcggcgcgagcggctgactgcccgtagaggaaacgacattcggagctgcgctcccgcccaggccggccctgacgcgggcctcgtcagccagtaacagggagcagaggtgggagttagcgaggcgaccacgaaaacggtgaaggtcggaaccgacagcctcctccgagaagggcaggagctgggaggaggcggcagcggcggcggcagaaacagcagcggcggcggcggcggcagctgggaggaggtggtgacggtggcaacggcagcgtcggggacgatg

SEQ ID NO: 958 - DNA, 816 bp, Homo sapiens
ctttctcttttagccccgcctgcttcccggctccagctggggccggagaggctgagtggttggtacgctgctcgctggcctcccagtcttcccagcaaccggtgacactgcccgcgccagactgaccactagccgacgcgggcgagagggacaggagcgtgacctccccatcccgaggggccggacgctcgggcgcctccccgctccccccactcggaggccgcgcgcgccgttagccccttcctcgctcccccgccccagtcccgcagtccgggaggcgggggtcggcagccggctgagtgggaaccgcgcggtgtctgaggaggcagtcggcgaccggtttccacttcaagcgtgacccttttgcctgtgggatgagctccagcatggggtgaggtacagaagagagacttgaagagcgtgccttgggactcaagcgccaaacctgtaccctagcgagtgtcctactccgcatccgtaatggaaggaaatgcacatcttactccagaggcacaagaggaggacatcccatgcggctactcctgcccagcgtggtggggcagcagaagctccagagcccagacttgcaggctcacggtgcagggtgaacctggccacagctcaccctggaacagccacaatgtctgccccttagagaagaaccctgaaatcagaccagtttttgcggcctccccctttcctctctgttacagtgccctttccaggccttaagagaagtaaaacttagctgcagcgccaggaggtggaccccagagtgtgagtggcacgcttccctgtgaacccgtcctcaccatg

SEQ ID NO: 959 - DNA, 148 bp, Homo sapiens
ccgcctccgtcccggctgcggcccctgccggttacataactcgttgcgggctccgcgcggtcccacttcccggctcccttcgcctccaggatgcgctgagccctacaacacccccagcggccgccggctcccccacgaggtgtgaatg

SEQ ID NO: 960 - DNA, 237 bp, Homo sapiens
tgccctctgtccccgcggctgggtctcgtctgctccggttcctgggctcctaattcttggtccagcttcttccaggtcagtgtgcgggccttccacgctgccagcggaacactggaatggcggaaggggaacgggtctgcgcgtctgttgttcccagcgctctgcgaagcctgaaaaggaggagcaacctgtccagaatccccgcaggacaggaaaaggaggggaaatctcgacatg

SEQ ID NO: 961 - DNA, 673 bp, Homo sapiens
tcccctttgtctccccactccccgcccaggcctggcccgcctgcctggccactcttcctccatcagcctggctggcagcagccttggactccgcccgtggagccctgggcctgttgacccaccagcttaggagcacccaccaagctctgggtaaggaagctcaccttctggggctcttctgggaaaatagaggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctggtgaggggaggctctgccccaggccgcggccttgagctcagagggggtacccaggcgggcagggaccgtccaggcccacgggctgcagcggcagtcgcgggggtccgcggcggcctgagcacgcgcccgccgcaggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatg

SEQ ID NO: 962 - DNA, 189 bp, Homo sapiens
catccttcttgctcaaccactgggtgcacaggatggaaacttctattccctctctggaagacagcgcgtggcttggcttcacagagttgtggctggagaccgaagcagcccctttctcaggcttactgtcaccagtctgtctgtgttaggggagaggggagtccgctctgtcctgaaggcccagagatg

SEQ ID NO: 963 - DNA, 137 bp, Homo sapiens
ccttcttctttcctgcctcaccttccaattcgtttgccgccgccgtcccgcagctgctgtttccggagttgccccttccccatgttccggggcaggagtccgcaaagcgaagatccgcccgccggttcctcatcatg

SEQ ID NO: 964 - DNA, 158 bp, Homo sapiens
ccgcctttgctcggcggagacagcaggcagagagatgaggaaactgagacccagaaaggtggaagcacttgtctaaggtcacgcctccaggaagcagtgtgtccacgactccagtccaagtggtcaggctccagagcccacagtcccaggggtccatg

SEQ ID NO: 965 - DNA, 101 bp, Homo sapiens
agccctcctcacacccccactgggctcctgcattaagcccggggttcgcagccgcagccgggatcgggcacccaggggcgggcgggcacggtagggccatg

SEQ ID NO: 966 - DNA, 509 bp, Homo sapiens
catcctctctgggaatttaccgatgcccagaacgcccttctttcccccacacgaccctctcctagtctaactcctgggcgtgctttaagctcagctcaggcagcgtcaccttctctggaaagcccaaacccagccaccccactacccgctacccgcggcccacgctgatgaagacagcagaacacggaggccccgcgttcccgccgcgagagcaggagagaaagattacctcccgcgagctctagcgcgcccggctttccggcgcactccagggggcgtggctcgggtccacccgggctgcgagccggcagcacaggccaataggcaattagcgcgcgccaggctgccttccccgcgccggacccgggacgtctgaacggaagttcgacccatcggcgacccgacggcgagaccccgccccatccccgactgcctgaaccgcgccaggagacggaccgcaagtccagcgtacccacagacgactcaggcgggagacgagcggtgtcatg

SEQ ID NO: 967 - DNA, 192 bp, Homo sapiens
cgttcttttaggggtggagccggcaggaaatttaaactgaagccgcggccgaaaacgccaagagattgatgctgtagctgccctgagataaccaggactgtggaatcgggaagagctcatggagctcgcgaatgtaatacggaggcctctgaggaaggagtacggaggccgagaaggagccggcatttgatg

SEQ ID NO: 968 - DNA, 13 bp, Homo sapiens
atttccttttatg

SEQ ID NO: 969 - DNA, 439 bp, Homo sapiens
ggttcctttcctcactgcacgctcttgcccctcctcttttctctcctgcccgtgttcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatg

SEQ ID NO: 970 - DNA, 363 bp, Homo sapiens
cctcccctttctgctgttaccgggagcgcggtggccacggaacgctgcccggagccgcgcgagggaggacccgacgcgcggcgtttacccagcgcagcgttccaccgctcgggtttggctggataaaataaaaaatggggatattgacctcctgtcactactgcatggactttgatggtttccaatcattactttctcctctgtgtcaatctgcctcttcgagaaattcatactcctgaatagctctccagacccccagctggccatgtggtgagttcagggcccaaatcaagtagtaccagcaatcagggaactcctatctgttttgaatggattcacaccagccacaagcctggaaagatg

SEQ ID NO: 971 - DNA, 113 bp, Homo sapiens
ctccctcttcccccgccccgccctgggccaggtgttcgaatcccgactccagaactggcggcgtcccagtcccgcgggcgtggagcgccggaggacccgccctcgggctcatg

SEQ ID NO: 972 - DNA, 155 bp, Homo sapiens
gggcctttgtccctcgctgtggcctgagctccaggtctcgtcttcagcgctctgtgtcctctgctcctagaggtccaggctctgtggccctgtgacccgcaggtattgggagatctacagctaagacgccaggaacccctggaagcctagaaatg

SEQ ID NO: 973 - DNA, 236 bp, Homo sapiens
gctccttttgcaggctcgtggcggtcggtcagcggggcgttctcccacctgtagcgactcaggttactgaaaaggcgggaaaacgctgcgatggcggcagctgggggaggaggaagataagcgcgtgaggctggggtcctggcgcgtggttggcagaggcagagacataagacgtgcacgactcgccccacagggccctcagaccccttccttccaaaggagcctccaagctcatg

SEQ ID NO: 974 - DNA, 55 bp, Homo sapiens
gccccttcctcactaccctccaaatcccgctgcagccattgccgcagacacgatg

SEQ ID NO: 975 - DNA, 358 bp, Homo sapiens
cgccctttaccaacatggctgctgacgccacgccttctgggactcgtagtccggtcctcgcgcgctttcttacctaactggggcgctctgggtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgactcagattcagactctgagggaggagccgctggtggagaagcagacatg

SEQ ID NO: 976 - DNA, 175 bp, Homo sapiens
ttgtctctctgtcagtggcggctgctgcctgctctggaggcaggctgggcggtggcggccgagactggcgggggtggacgcccgggccgggctgcgcccgcttcttgcagctgtgaattcctttggacaattgatgatatttatcattgtgcccagtttctacaaataaaagatg

SEQ ID NO: 977 - DNA, 123 bp, Homo sapiens
ctgccttcatctctccatctctgcgctgctgccggctgcgccatccagcacccagactccagcaccggccgaggacccccactccggctgcagggaccctgtcccagcgagaccgcaggcatg

SEQ ID NO: 978 - DNA, 271 bp, Homo sapiens
ccgccccttccccggagcctcacttccgtcacagtcctgtttctctccctgttgtccctgcctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatg

SEQ ID NO: 979 - DNA, 132 bp, Homo sapiens
cgttctttggccctgtgacacgtagcaacggggctggttcagggtctgaaacagagtttgggggttgtttgggattagtgaagctactgcctttgccgccagcgcagcctcagagtttgattatttgcaatg

SEQ ID NO: 980 - DNA, 272 bp, Homo sapiens
cctccctttccagagcccccagttccttagaaaccaggcggcgcgttcccggtggcggcgccctggactcccgggcccgcgcatccccgccagccttccttaaggcggatgggtggcccccgagaccccgtcggacccatggtttccagtgcagcgcggagtgggcgatgccagcgtgccaggagccatgtctgaccaggacgtttggaagatcatatccatgccagaggctcttgtgaggagatgagttggtaaagagagaggctgggatg

SEQ ID NO: 981 - DNA, 275 bp, Homo sapiens
ttccctttcgaattccagggtatatctgggaggccggaggacgtgtctggttattacacagatgcacagctggacgtgggatccacacagctcagaacagttggatcttgctcagtctctgtcagaggaagatcccttggacaagaggaccctgccttggtgtgagagtgagggaagaggaagctggaacgagggttaaggaaaaccttccagtctggacagtgactggagagctccaaggaaagcccctcggtaacccagccgctggcaccatg

SEQ ID NO: 982 - DNA, 155 bp, Homo sapiens
ccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatg

SEQ ID NO: 983 - DNA, 63 bp, Homo sapiens
cttccttctttgccaggcagacgcccgttgtagccgttggggaaccgttgagaatccgccatg

SEQ ID NO: 984 - DNA, 189 bp, Homo sapiens
ctgtctctaatctctgcaacagccgcgcttcccgggtcccgcggctcccgcgcgcgatctgccgcggccggctgctgggcaaaaatcagagccgcctccgccccattacccatcatggaaaccctccaggaaaaagtggccccggacgcgcgagcctgaggattctgcacaaaagaggtgcccaaaatg

SEQ ID NO: 985 - DNA, 68 bp, Homo sapiens
tgctcctttctgcccgtggacgccgccgaagaagcatcgttaaagtctctcttcaccctgccgtcatg

SEQ ID NO: 986 - DNA, 155 bp, Homo sapiens
gggtcctttgtctctcggtgcagccggagctccaggtctcctcttcactactctgtgtcctgtgctcctacaggcccagcctctgtggccctgtgacctgcaggtattgggagatccacagctaagacaccaggacccctggaagcctagaaatg

SEQ ID NO: 987 - DNA, 83 bp, Homo sapiens
cggcctctagccacaccgagtccgccgcggcgtccagggtcggcagcaaccgcagccgagcccgagcgggtggcggcgccatg

SEQ ID NO: 988 - DNA, 126 bp, Homo sapiens
cattcttctgcgacggcgcggacctggagcttccgcgcggtggcttcactctcctgtaaaacgctagagcggcgagttgttacctgcgtcctctgacctgagagcgaaggggaaagcggcgagatg

SEQ ID NO: 989 - DNA, 26 bp, Homo sapiens
gtcccctttcctcgcaggacctcatg

SEQ ID NO: 990 - DNA, 159 bp, Homo sapiens
ctttcttcctcttggcttatattagggataggggatgtggtttgttacaaaggatgagtattttgatagcttctcattccttgaactattctgcaggtttataacaaagctcagaaaatactaaaggttaaaggagaattgagagctgccaaggaaatg

SEQ ID NO: 991 - DNA, 89 bp, Homo sapiens
cttcctttctcggaaacgcggcgcggccggctgccggaaaacagggcagacctgtatggttcgtttattcctggggttgtcatatcatg

SEQ ID NO: 992 - DNA, 243 bp, Homo sapiens
tattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatg

SEQ ID NO: 993 - DNA, 219 bp, Homo sapiens
atttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatg

SEQ ID NO: 994 - DNA, 951 bp, Homo sapiens
ccttcctttccccagtgttgagcgcggtctcgcctccgcttcctcctcactccgcctgccggctgggaaactagggcaccagtacgatagttccggcaccggaaaagagggctgatgactgggcccgggggccgccgcaacgacccttggggccggcaaagagccagagagggtgctcacacttccaagcaccccacaccaaggacaggctggacggcaaggcggagacgcggggcttgggccctcagaccggggacagcaggaggttgggccaagggccaggacttcccgtcacaatttcatttgttgatcccggcaccgccaggtaaggggggccctgagtgaggctaggtatctggtacggataaagttaggtatagagtagagcggctgcccgctcagggttatccctaaagacagttggaggagagttgcttggggcctcggggatgcactgggcgggatcagggcttacacctaggactggcaaaagagcgggacccggcagaggcggggcttgccgaagggacgagcctctattcaggaaatgcacgagctttggggcggggctcaaagaaaggggcggggcttccggggcccgcgtcctggtgagctgcgcgtctgcgcgaggattgggcgagagggtggggccactcaacgctgaggcggcgaatggccggagcagacttaaatcaagaggctggggacctctaagatcaaagtttggggcggggcctaaggagggggcggggcctccagattcgagacctggaagggctggggcggcgcttggggcggccctgccgccgcctcccgttctcccctccgcagcggcggcggtggcggagaaggaactcgacacgcaccgaccgccctcccgccccagccgaagcggaagctgtagcccgctctgggccggggccatgggcgccccgcgccgcccgggtcatg

SEQ ID NO: 995 - DNA, 42 bp, Homo sapiens
ggctctttttgacagcccccagtgcgaaaggctgccagcatg

SEQ ID NO: 996 - DNA, 60 bp, Homo sapiens
ggttctctctgacgtgggagccgccgtcgctgccgccacccggaggctcttgtcaggatg

SEQ ID NO: 997 - DNA, 177 bp, Homo sapiens
aggtctttctccacaaaagaaataacagcgtgcattacgtattcagatactgctttgcttcatcctctctaaaatttaacaccgaggagtttaagaaatgaagataaggaactcgaattatttttaaactttggatcaatgtaaaggcaatctaatatttggaaaatacttgcaatg

SEQ ID NO: 998 - DNA, 267 bp, Homo sapiens
gcctctccttgggccccttctctccccctttcccctccctgctggttcctggcatcgccagatgctgcgcagcagtctccgattccccatcaccaattcggctggcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatg

SEQ ID NO: 999 - DNA, 86 bp, Homo sapiens
gctcctcctgctgtgggaccgctgaccgcgcggctgctccgctctccccgctccaagcgccgatctgggcacccgccaccagcatg

SEQ ID NO: 1000 - DNA, 882 bp, Homo sapiens
gggtcttttaggagagcactgctgcagccggcagtggagagcctgggcagggagacagggagaaaactccggcagcagggtggtctctagggctgacctcggagcctggggacaggggagcctatgccgcactgaaggcgggacgctgtaagcgaggagcagctgggcctgggcggactcctcggccaatcagcctcggtcagcagcaccctcaggcgcagggcactgtttgggcattgcctagagatccgacaccccgcccagatcagcgcagggaggcgaaagcgacagccgggcgcgggaggagaccagggcagctgtcccctccgcgagggtggccctcgaggcaatgcgggtgggggctggtgaggaggcggaagggccgaggctgagtgggaggggccggggcgccagggctggagcgcgcggctcgggggtggaggctgcagagccagcgagcgagcgaggggcgggggcgcccgggccggcgcgcaggaggggcgggggcggcggggaggggggctcgggctgcgtgtgccggagccggcgggggcggcggtgcgtgcgcatgacgcggggggagggcctgggccgcgcgctcccggtcccgttgttgttgccgctggaggctgctccgaggcagcgggatcacggcgctgggaagcgctcggcagcggcggccacagcgtgcgcggcggcgcctcctggcctcggcctccggcccccggcccccggctccatgcgctagccccgcgccgccagcccagtagtcccggccccgccagccccgcgctcccgctcgccgctgccgccgccgccgccgccgccgcctccgccgcgccgccccgggcccgcctcgggccccacggctccgaagccatg

SEQ ID NO: 1001 - DNA, 52 bp, Homo sapiens
ctgcctctctcagtccgggtttggagactcctgcgtcctccgacttttcatg

SEQ ID NO: 1002 - DNA, 225 bp, Homo sapiens
cattctctgcgaccggcagccgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatg

SEQ ID NO: 1003 - DNA, 23 bp, Homo sapiens
gtttctctttccgggacaacatg

SEQ ID NO: 1004 - DNA, 220 bp, Homo sapiens
cagcctctagcctgggattccctgcgcagccaacaacagaaaagaaaaccagctcccacacagaggctcccggctgcgcagaccttgcccagcacaccagattgccagctccgagacccgggactcctcctgtcctgggccgaatgctcttttagcgcggtagagtgcactttctccaactggaaaagcggggacccagcgagaacccgagcgaacgatg

SEQ ID NO: 1005 - DNA, 547 bp, Homo sapiens
ggctctttcggcttccttcctcgctgggccggctaaacccggccgcagcagcaccggggtgataagtgtccagggcaggaggccagcgatgttgccttgctaaccgggtatctaagagaaacagggtctttttattcttaggctcgacagtctgacggccctttttctgaacgggaccctgcaggtcttccgcctgctgttgcattaaatttgggggtggaagaggcttctgcgttgttccttacccgcaacgatgaccatggctttgccttctttaaaattgaggcctccaactctgacgctgactggagaattgaaacccgaacacacattgggctcttttggcacttgactagagctaaaacctcgggattcagcgggcaagcgttgctcagcaacggcgcgtaggctgtgtgcggttggctggagccagaccccaccccggcctcggcccatgctctagaggggacgttgccccaatcctgaaggacttcggcactcgagacctgtggatgccgcgttgctgtggcctgcgggggtgatcatg

SEQ ID NO: 1006 - DNA, 80 bp, Homo sapiens
ccgtccctctacgcgttttggttcccggttggtgcttcctgttcgcagctgcggcacttcaaggttactgactttttatg

SEQ ID NO: 1007 - DNA, 266 bp, Homo sapiens
gggcctttctggacttggactccttgggagtcgtttctcggccatttgacccgtgggacttgtgggttttgtgctgctttttctttctttcttccccttttccaacttcagcaatacacccagatgttagtcgagtcacgtcccgccgccctctgcccttgaaatgctggcaagtacgcagccccgcgatcgtcacgtgacgccggggttcagcgtatccttgctgggcaaccgtcttagagaccagcactgctggctgcaccatg

SEQ ID NO: 1008 - DNA, 101 bp, Homo sapiens
cgctccctcggtgcggcgggctgcgtgcgcgagtgggaggtggcaggcctgcgactccggccttgtccgcgcccgctctcggcgcgacgtctccagccatg

SEQ ID NO: 1009 - DNA, 225 bp, Homo sapiens
ctccctttctctcagcatcttcttggtagcctgcctgtaggtgaagaagcaccagcagcatccatggcctgtcttttggcttaacacttatctcctttggctttgacagcggacggaatagacctcagcagcggcgtggtgaggacttagctgggacctggaatcgtatcctcctgtgttttttcagactccttggaaattaaggaatgcaattctgccaccatg

SEQ ID NO: 1010 - DNA, 18 bp, Homo sapiens
cagccctttttgcaaatg

SEQ ID NO: 1011 - DNA, 300 bp, Homo sapiens
gagcctcttgcttgctgtgactggtggagctgccgcgctgtccgcgttatctcctcccggtgagaacgaaccgcagtgtccaccggcgaggagccagccctgtcccggtcagagaaagacgacgaggatacctgggagcgggcggcggccgggctgggccgcgccggtgcgggctggcgactctgctcctccgcttgctgctgtctctgggaactgggtgccagcgctgaggggcttccagcggacagggacccccttccccggctcccctgcccaccctgccggggagggcggaagatg

SEQ ID NO: 1012 - DNA, 33 bp, Homo sapiens
tgccctctctcatgaccccgctccgggattatg

SEQ ID NO: 1013 - DNA, 27 bp, Homo sapiens
ccgcccctttggagctacttcctcatg

SEQ ID NO: 1014 - DNA, 270 bp, Homo sapiens
tcgcctcttcgcattgtgagctctcgcggtaagaggctgaggagccggcctgcaacctgccggggcggctccgctacgcgcagccgcctcagtggcttcctccacagccacctccggagggatctggctgaggaggaagtggaggtgtcactggccccggcctttgccccaatcttgtgtgggcactgaagggggactacaggttcgagagttatgggtgctacatgtgtgctttcagagcagtagtgtgaggaagcttggagtgggatg

SEQ ID NO: 1015 - DNA, 146 bp, Homo sapiens
cggtctttgtggcttgcagctcggggtgggtggctcatttcctggccgctcctgggcttcgcggaaagaagagattactcacactccttcgcaagcacagaaccagttgtactgagctttttgctaagctgtttcagccaagaatg

SEQ ID NO: 1016 - DNA, 35 bp, Homo sapiens
gctcccttcccggcggcctttgcgggaacaagatg

SEQ ID NO: 1017 - DNA, 806 bp, Homo sapiens
cttccttctccatattgtatactggaattgaagccaaggaggtaccattttgctcgagggcatggcctaagccggtcagctaaggccatgttaatacggggctgtcccatctctctgcggggcgcgacagctggaagagccgaacggataagagaagaggaggtgagaggagctgtacaccacaagaggcactgagggactcaggataacgggatgaagccgtcagtgcccccagaaacgaagcggccccggacgaatttctgagtcaccgtcgcgagaaagcgggctgagccgccattttgaagcctggcaaaccgaagcaagaaatgctgccgtgttggatctttgccagccttcgtgccgaatgggagcaggttggagggagggagagccaatatacactatgggctgattaagcccggttggctgccatgttgttaacgagcaccgatttcctctacttttgtcgaagaagtttattgtgggtcagggacgtcaggtcgcttgccttcgtttactgtggtcatgattgagcatatgaggacggccattattgttgggggcaaatggaaatgctctaggcggggccatttttcttaggggcaagctgtcgtcacccttgtcaactggttcggatgaagcccctgtggccgccatcttgatctcgggcggccccgataagggaggcggagtgtgcggagaggaggcggggcaactgcgcggacgtgacgcaaggcgccgccatgtcttttgagggcggtgacggcgccgggccggccatgctggctacgggcacggcgcggatg

SEQ ID NO: 1018 - DNA, 18 bp, Homo sapiens
ctgccctttcccaagatg

SEQ ID NO: 1019 - DNA, 206 bp, Homo sapiens
ggccctccctttcatcagtcttcccgcgtccgccgattcctcctccttggtcgccgcgtccttggctggcgttagagacagggtttcaacgtgttagccaggatggtctcagtctccagaccctgtgatccgcccgcctcggcctcccaaagtgttgggattacaggtgtgagccaccgtgcctggccgaggctccttcttttatg

SEQ ID NO: 1020 - DNA, 73 bp, Homo sapiens
cgccctccccgccgtggattggcccgcggcgggacccgtcagccgcggttgtgtctgggaaggagagaaaatg

SEQ ID NO: 1021 - DNA, 935 bp, Homo sapiens
atttctctcctccctgggggtctcagtgcatctccttctcctctctgcctgcctcctccctcaccgaagggttagcggacacccatccttttctgcttggggaccccaccaccacccgcaacactgccgctgtctcttcttcaccgtatccttctctacccaccctcttctctcttctcttctccctgcccctttaaatctgcctggcccagcctcccccgtgatgctgggatggagcaaacattgatttgtgctgggatggaatcggaattttgatttatttttcctctcccaaccataagaagaaaaaaataataaaaacaccccctcttgagagccccctccccctttgcatccagctcccagctcttcttccctatctccatccaaggcagattttttcccctacactattctcatcttcccccacccttgccactacctcgcccccccacccagcctgctcctccagctggggagagaggggactctccggactcccccacctttcctctctgggttggagcagtctctccggaaggggagggggcttggcttgtccgggcgaggtgggagtggaggtatcctgccatggatgctgtgccggggaggcagcctgagccccagcccacatgagacgccgaagaaccggggcagaggggtcctgacagcagccagggaaacgggtgccctacgattctgcccagccccctctcaggacccccaaactgccatccacactcgacacttcggggttctagccactcaggatgagggtccggccctgcctgccctcgctggggcccccccgcccggccccggtctaactgcccccgccccgaggcctcgcccggctccaaggcccccagcaggctctccagtcccaggatgcgctgagccgccggggggctgaggccgcgccaactacatgcatg

SEQ ID NO: 1022 - DNA, 154 bp, Homo sapiens
ttttctttctcctcctccaaccttggcggaggccacgactcaggcgccacagctgggggctagaggccgcggaccatggtgcggggcagccaccgctgaagtcagcaaaaccgagcctggcctgaggcaggctgcgcgggaggccaaagccatg

SEQ ID NO: 1023 - DNA, 194 bp, Homo sapiens
cgctccttctttctggccggatgtgtgctgagacccagagtcacccaggggtctccgtcacgtgccaggagtaggcagaagtgggctgtgacagatcaggaaacagagctcagtgcagcccactaaattgctcagggccctacagctaacaagcggcagaggcaggatctgcactcaggagctgcttggagatg

SEQ ID NO: 1024 - DNA, 73 bp, Homo sapiens
ggctctctctgcggcttggcccgttagaggcggcttgtgtccacgggacgcgggcggatcttctccggccatg

SEQ ID NO: 1025 - DNA, 120 bp, Homo sapiens
agttctcttcacggagccgcgcggctgcgggggcgcaaatagggtcagtgggccgcttggcggtgtcgttgcggtaccaggtccgcgtgaggggttcgggggttctgggcaggcacaatg

SEQ ID NO: 1026 - DNA, 287 bp, Homo sapiens
gttcctttcctgggcatcagcttgcctgctctcagcctaagctctctcgccaaccgtggtggctccttgcgttcctacatcctctcatctgagaatcagagagcataatcttcttacgggcccgtgatttattaacgtggcttaatctgaaggttctcagtcaaattctttgtgatctactgattgtgggggcatggcaaggtttgcttaaaggagcttggctggtttgggcccttgtagctgacagaaggtggccagggagaaggcagcacactgctcggagaatg

SEQ ID NO: 1027 - DNA, 31 bp, Homo sapiens
tctccttctacggatatctgtggaccttatg

SEQ ID NO: 1028 - DNA, 161 bp, Homo sapiens
gcttctttccgcccggctccttcagaggcccggcgacctccagggctgggaagtcaaccgagctcccttccaggtcaatccaaactggagctcaactttcagaagagaaagacgccccagcaagcctctttcggggagtcctctagctcctcacctccatg

SEQ ID NO: 1029 - DNA, 197 bp, Homo sapiens
cctcctcctttcctccctctactctgacacagcacttagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatg

SEQ ID NO: 1030 - DNA, 112 bp, Homo sapiens
caccctttcactacttctcccccggactccttggtagtctgttagtgggagatccttgttgccgtcccttcgcctccttcaccgccgcagaccccttcaagttctagtcatg

SEQ ID NO: 1031 - DNA, 147 bp, Homo sapiens
tttccttcctctcttcccttcgcagaggtgagtgccgggctcggcgctctgctcctggagctcccgcgggactgcctggggacagggactgctgtggcgctcggccctccactgcggacctctcctgagtgggtgcgccgagtcatg

SEQ ID NO: 1032 - DNA, 128 bp, Homo sapiens
gcccctttctttccttcgcttcctcttttagagaatgtccggattgctattggactttggagcgtatggctccaaatcaactcattggctaaaacttgacggaaaatggtggttaggtggccagaatg

SEQ ID NO: 1033 - DNA, 314 bp, Homo sapiens
cggcctcttcccagcgttcctcctccggccccaggtcaccgccagcacgcgcctgcttcccgtctgcgcgagtccacgcagctccccagatcaagaagctgaggccccaggttacacactaaagtaaatggcagaggcagaaataacacctatgtcctcctgaccccaaggcatgttcttaaagttctggaaacctcctggaggcttccttgctgctcctctgggactgccaccctgggcagggtgttctgtggcccctcatcatcgtggttttgaaccacaggcccttcaccagcacagcagcagcaggcatg

SEQ ID NO: 1034 - DNA, 127 bp, Homo sapiens
catcctcccgccagcctgcccgcctgctcgccggcgcccggagcccgctctggccgcttgctttttgctgagaaagcttcctgccctggaagatggcacccttccccatccagacaccttgggaatg

SEQ ID NO: 1035 - DNA, 197 bp, Homo sapiens
cttcctccttttcacggcgtcttgcattactattgtgcggctgcaggaggtgtcgagcggcgttatttttttttgcggtttgcctttttttttcttttttttttttttggaaccgcggttgtttaaaagcctgagggaacctggagaggggctcccactccctaccctctttcctccgagtttgtgactccgagatg

SEQ ID NO: 1036 - DNA, 180 bp, Homo sapiens
ggctctttgtcgaagctagaggaccggcaggcggcagcagcaactacggcggcggcggcagaacccagcagcgatgtggaggtggagacccacaggagccccggacttcacctgagctacctcagtggtcaccaagagtggcaagataaagaaaaccctgagttgggcgggaccaggatg

SEQ ID NO: 1037 - DNA, 119 bp, Homo sapiens
ccgtctttcagtttcacttttgttttcctgctcccagcagggttaggcttgctgaggggcaggcacaggagtcctggctgagctcatggcctgaggctgcctagcggccacggggaatg

SEQ ID NO: 1038 - DNA, 20 bp, Homo sapiens
ccgcccttccttgtaagatg

SEQ ID NO: 1039 - DNA, 509 bp, Homo sapiens
ctgcccttccgcagcgatggcatcccgggtgagtatcggccccggccgagcccccaaggcgggcgggcagcgcggcagggccgggacttgagcggaggaccgagtaggcgcaggtgtccgggcccaacaggaccaggaaggtgtcggggttggaatgagtgggtacccgggccggggacggtgcgagagggtgccttgcttgggagcggaacgagaaggtacttgggtcagggaggtgatgcccgggcctggaacgtggcggggattggagcaggcgcgcaggtacccgatccgaggcggggagagcacccgggatggaaggagcaggcgtgcgggccgtgagcggcgccagagggtacctggctctgtggaggggccctctggtatgtgtgtccctgtccttctggggcgtggatggtgcctgggacccagctggcaaccagttgaagacgttctccttggaagctcttggccctgaggactttgcctggggcattggccctgccatg

SEQ ID NO: 1040 - DNA, 463 bp, Homo sapiens
gcgtctcttccggcgtctaggggggtgtcctgccggcgcgcgggccctgcggccattttgggcttcgcttccaccgcaccagccggcctacccagtccttccggtatcgcgttgctcaggggcttttcaaccctctgtcagtcggaaaaccatcgccgaggccgtggggggactcctatccatggtgttgaagcgtcgagccgactagggaacctccttccccgccaggatggaagtcgcatcagtcgccgcctattgcgcgggctgttcttccctgtgttctgccgcccgctgccgcattcgctgccctctgtggcttttctgctggctcgaagatcggcctggagcagcgacgccaccgctgggcaaggccgagactctgtaggcttcctccgaatcccgtcgacctccagccgctgagcgccgcggccctacctgagagactgtcaagaaaaaggagatg

SEQ ID NO: 1041 - DNA, 51 bp, Homo sapiens
ccctctcttcgcggagcggcgccgcgtagcttccatccgccagctgccatg

SEQ ID NO: 1042 - DNA, 159 bp, Homo sapiens
agccctttacactacggtgtttccggcttcaagatggtcgcctaagctgtttagtgaaacttcttccacctttctccattcctctaggtgctttttctgaacctggatgtgaggcattaaaggatccgacggaaatagaattgaaggcattctaaaatg

SEQ ID NO: 1043 - DNA, 187 bp, Homo sapiens
cctcctccgtgtggggcagctgctggctgggctgcctgttgagtcagccttcttccctcacggctcttctcccggtccctgaaactcggctgccaggggagctggagccacctgcgaaggtgtcctcccatactggacccctacaggaagctccgtgtgcccagctggggcacagccccagctgatg

SEQ ID NO: 1044 - DNA, 367 bp, Homo sapiens
gctccttttcctttttgatccattcaaaaattactcattgcaaattcccggactgctaggcgaggagagggaagggggcggaggagacagggctactgcaggcgcagagctgggggcagccgggggcccgagtggctgaggctggtcccgcagcggccgcttgccggcgttctggctcctgtggcctcaccaggaagcgtcagagtcccgacactggggaagctcggagcgccgcctccgctgccgccgcctcctgcctggctctgggtccccgagccccctcccctggcccagcccgactccctcctccttcccgaaccatccggctcgggctccttccctggcgatggctggccgctgagccatg

SEQ ID NO: 1045 - DNA, 114 bp, Homo sapiens
ccgtctctgggcggctgctgccgctgccgctgctgctgctgcgggggtcgggcggcggccaggggatttgggcaggcaccgtggatccccgagaaggggacgagttgacagatg

SEQ ID NO: 1046 - DNA, 372 bp, Homo sapiens
gagcctctgccagccctgagctgggaagaagcagctacctcggaggcagggcgcgcaggcgggcggcgatgagagggggcgcagccgcagccccgcgctggggagcccaccgctaaccctgcaccccacccacccctgcacaaaagagctggcgggcgctggccacgtcgccctgggtgaccttcctcggatgcagaatccgcccctgcgagcatcctcttcctcctaggctctgaaggcccggggagcgtgagcgatgcccagctgcacccgggcagggctcgcctttgtttgccagtaaggaggagaggctgtctcagctgcagaggggtcatccctgcttcaagccagtgcctcttcccagctcccatg

SEQ ID NO: 1047 - DNA, 189 bp, Homo sapiens
attcctctctcacccccacgcagaggagagaacttgcttctggacccgggtgggtgccggctcggctctccttgtcttccagagcggtggcccggaagcacagtcctcccagacgccagcgccagaagctcggatcgcggctgcaccgggagagcgccgatctgggtgcgaggcaggtgcggggccatg

SEQ ID NO: 1048 - DNA, 257 bp, Homo sapiens
gttcctctaggaaaattcctttgtgcagatcaggcccgtggattggtgagtgaatcctaaccacgtcttccctggcctgtcttcactcttctccccagaatcaccacttctgcactggtgtctgaaggtgtattgagtgattttgtggagggcagaagtaggaagtctttgggacaaaactgtatttaccttgggatctgtgaacaagaggaacctcagcagccaggacaggcaggagcagtggaatagctactatg

SEQ ID NO: 1049 - DNA, 20 bp, Homo sapiens
cgccctctcgcgcggcgatg

SEQ ID NO: 1050 - DNA, 73 bp, Homo sapiens
ctccctccctgcagcccgcaacgggaatggagtaaagggagacccgtcgacctggccacggggatcagcgatg

SEQ ID NO: 1051 - DNA, 260 bp, Homo sapiens
cattcttccggtttcagaagttaaggctggtgtcctggccccagtccacctctgggagcgcctgcgccgctccgcggagagtccgtggatctcacagtgaaaaatgtttgctgacccttgacattgacaaactgctgacagctcagatgatccatgattggaaggatgtggtcatcaccaagatgtctttctttctccggttcccagttttccagacctgaagtgttttccaatcaaagcgaagagacgatctgtggatg

SEQ ID NO: 1052 - DNA, 370 bp, Homo sapiens
ggctctcttgcgcaagcgcgctgtccgcttcttctgggcggacgctctggaggcaaaacatttccctgctgggggcggcgaccaccgtgagcgtcccggaaggggcggcaaagacgcctccgtcgcgcacgaggtggcctcgttggctttaccttggttcgcggtcgtccttggttatcgtgagcgtccgcgagtctctgggaggccaagcctaggggcgccacagcgcctgcgcgcgtacggcggccggaaggggctagaggcggctccctgggtgacaaccgcgcgccccacctttccccacgtggccgcgaagaccggctcaggagcatctatcggctgcacgccaacatcaacacaggcgaagatg

SEQ ID NO: 1053 - DNA, 36 bp, Homo sapiens
gctcctcccccggcggcgagccagggagaaaggatg

SEQ ID NO: 1054 - DNA, 63 bp, Homo sapiens
tgccctcttgtttttagtctcgcttttcggttgccgttgtcttttttccttgactcggaaatg

SEQ ID NO: 1055 - DNA, 126 bp, Homo sapiens
ggctctcctaccttctcgggcagcccagtctttgccatccttgcccagccggtgtggtgcttgtgtgtcacagccttgtagccgggagtcgctgccgagtgggcgctcagttttcgggtcgtcatg

SEQ ID NO: 1056 - DNA, 563 bp, Homo sapiens
ccgcctctgccccgcggcgagggtgtctatggagaggcggcggccgcggctgctgaggcggaggctgaggcagtggcgatggcgccctttcctgaagaagtggacgtcttcaccgccccacactggcggatgaagcagctggtggggctctactgcgacaagctttctaaaaccaatttttccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagcctactactgttgactggaagccttaccaataacataaaacaatcgaataacaattatttcatgtattatatgtaaaatatatatactggattcttacagtaagaatgaatatgaacagttaaattatgcaaaacaactgaaagagagattggaggcttttacaagagattttcttcctcacatg

SEQ ID NO: 1057 - DNA, 74 bp, Homo sapiens
ctgcctccactcggcctcagttcctcatcactgttcctgtgctcacagtcatcaattatagaccccacaacatg

SEQ ID NO: 1058 - DNA, 55 bp, Homo sapiens
tcgtctctctctctgcgcctgggtcgggtgggtgacgccgagagccagagagatg

SEQ ID NO: 1059 - DNA, 271 bp, Homo sapiens
ccgcccctcccgatttcctccgggctacaggcgacagagctgagccaagcgtttactgggcagctgttacggtaagtgaggaggggctggggtgcccagcgttttggatctcccactctggcccggccccggaataccacatagaggccttgggacctgattcatcccgtccagacagccctagagacctgagcgactgaggcctgggatctggacgccggaatttcctgcgtggttctggacgccctgccctgggctcagattccaaatg

SEQ ID NO: 1060 - DNA, 238 bp, Homo sapiens
cctcctcttgtagtggcgccggcttgcatcccaggtcgtggcggttttggtgcctgaagcagggagcgcggagtcgttcccgagagaggcggccaggctatgctcgccggtttccggcgttccgctccggccagccagagtctctgtctcaacctgtgtccgtgctccagcagtctcctcagcccggccccgcggcgcggttggcggcggcgccccaggcgcgccccctcctccgatg

SEQ ID NO: 1061 - DNA, 26 bp, Homo sapiens
cgctctttcccggaggctggcagatg

SEQ ID NO: 1062 - DNA, 187 bp, Homo sapiens
ctttccctttcggacatgcgcgctcggagcaaggcgccctcgcactcagcttaccgcgcatgtacgttgccaggggtaacgcaggtagccaaagtggcttgtggagtggcgaccgttagtgaggcggttgctgagacagacgctgaggcgggtaggaggagcccgagccgtaagggaagccgtgatg

SEQ ID NO: 1063 - DNA, 27 bp, Homo sapiens
agttcttccggggcggaggtcaccatg

SEQ ID NO: 1064 - DNA, 582 bp, Homo sapiens
ccgccccttcgcttataatgcagagcatgtgaagggagaccggctcggtctctctctctcccagtggactagaaggagcagagagttatgctgtttctcccattctttacagctcaccggatgtaaaagaactctggctagagaccctccaaggacagaggcacagccacacgggagtgaaatccacccctggacagtcagccgcaatactgatgaagctgagaagcagccacaatgcttcaaaaacactaaacgccaataatatggagacactaatcgaatgtcaatcagagggtgatatcaaggaacatcccctgttggcatcatgtgagagtgaagacagtatttgccagctcattggacattctcactattctatgccttaaaggcccttcaacggaagggatattcaggagagcagccaacgagaaagcccgtaaggagctgaaggaggagctcaactctggggatgcggtggatctggagaggctccccgtgcacctcctcgctgtggtctttaaggacttcctcagaagtatcccccggaagctactttcaagcgacctctttgaggagtggatg

SEQ ID NO: 1065 - DNA, 42 bp, Homo sapiens
ggtcctccttggctgactcaccgccctggccgccgcaccatg

SEQ ID NO: 1066 - DNA, 122 bp, Homo sapiens
ccccctccttcataaagtcctggcctcgggacagcctgcacagctgcctagcctgtggagacgggacagccctgtcccactcactctttcccctgccgctcctgccggcagctccaaccatg

SEQ ID NO: 1067 - DNA, 80 bp, Homo sapiens
cgctctccccggatcgtgcggggcctgagcctctccgccggcgcaggctctgctcgcgccagctcgctcccgcagccatg

SEQ ID NO: 1068 - DNA, 164 bp, Homo sapiens
gcccctctccccgggcagccgcggcggcagcagcagcagcagcagctggagctgtggggctgtcaccgccgcccgccccgctcactcgcggatcccgaccgcccatctccgcctcgcttccagcccaggatgagacttctgtgagcagcgaggattttgatatg

SEQ ID NO: 1069 - DNA, 244 bp, Homo sapiens
cacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatg

SEQ ID NO: 1070 - DNA, 336 bp, Homo sapiens
tttcctcttgagccatcatgcacatctgactgcagccccagcgagcccttccttccttgtctgactgctcttcttctcgatttcttcttgttctgccttctcggtttgcagccctgacccccgctgtgtgtctggcccttggtgactgtccgtgtttctgttcctgtcattgtaactgtgacttttctctctgtctgcccccccttcctactggttcatgcttctcccccattcccaccctctctgcccggcctcccgctcccgccctttctcctcatgcacccggcctcgtctctgtagtctctgcacttgtctcccattaaggtcccatccatg

SEQ ID NO: 1071 - DNA, 303 bp, Homo sapiens
cagtcttcctcccgccccttctttggtccctacggacctggggggcggtggcggtcaatgccgggtcaaggtccgcgggcctcgcagatcgtagcccgggcgcacgcgatcagatgatcctgttgtggacggctaagttgtaggcgggatggctgagaaagcggcgctaggacccccgggcagaggctcggggaagggagtcaggggggaaatgccttacaaggtcgccttgcggtcaccatcattgcccgccgcccaaaatagcccccggcgccagctggcctgccctatggccgagagatg

SEQ ID NO: 1072 - DNA, 81 bp, Homo sapiens
ctccctctttccctccctcctcctccgtccgcccgtccgtccgcgcgtctgtccgttcggcccggtccggcccgaagcatg

SEQ ID NO: 1073 - DNA, 819 bp, Homo sapiens
cagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagcggcggcaccagcggcggcggcggcggcgggaggaggaggaggagaagaaggaccaggcggcggcagcagcggcggcggcggggggaggaggggaggaggcggcggagcaggaggaggagaaggcggaggaggcagtcgctctccgcggggctgagccggacgcgtcgtcttgcccccctccccccggttcgcggtgccgccgtgtagttggcgccgctgccccggctgagagtgagcgtggtgtcgacggagggagatggcccgggagcgccggcgccagtaactgggagctgatgagagtcgccgagggcgcgccgggcccaggtgccggggctgcccgccgcccgccgccgccgccgcctgcgcgcccgcccgcctttcgcggccgctctcccccctccccgacacacactcacaggccgggcattgatg

SEQ ID NO: 1074 - DNA, 19 bp, Homo sapiens
cgctccttcagtctcgatg

SEQ ID NO: 1075 - DNA, 91 bp, Homo sapiens
cagccttctgcactcacagccgaagggaaagcagcaggttggggcttcttgtggccaacttcagagcctgtcaccaggaaaggtaagcatg

SEQ ID NO: 1076 - DNA, 352 bp, Homo sapiens
cgccctctagccccctcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggaccctgacgtggctgaagcggccccgggagcatg

SEQ ID NO: 1077 - DNA, 129 bp, Homo sapiens
agccctccccgcggccggctcggctccttggcgctgcctggggtcctttccgcccggtccccgcttgccagcccccgctgctctgtgccctgtccggccaggcctggagccgacaccaccgccatcatg

SEQ ID NO: 1078 - DNA, 342 bp, Homo sapiens
ctccctcttttctcagtaccctcctctttactctccgagttaactgagagccgacctgacatctccaacattttcaccctcttcccccacccccatcaccgagaatggagtcagggtttccggagagaccgaactctgctctcagcacctttcccagccgctgttgctaaactgacctcggaggacgagaggggaaggaggtgcgacgccccttacatcagtacataactaccacaccaaccacctccacttcaaagccggattttgcatcctgggggcgggacagacctcgtcccgggctgaattctctctccactcttcgagattggcacacccagaatg

SEQ ID NO: 1079 - DNA, 154 bp, Homo sapiens
ctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatg

SEQ ID NO: 1080 - DNA, 309 bp, Homo sapiens
aggtctcttgactctttccgcctttgtttacaaccctgccatgatctccctcttgcaaaagcgagggctacagaacaggcattcaggagtcctgtgctccagtcacagccttttctgttcttcagctaggagacaccaaaccctcaggaagatttactatagctaagagaaaactgcagcagaaagggcgcggctacctacttcttaaattccgtttgtggaccctcagactcttagtcccctactcccagatacagcggccctaccgtggctcctggcaaggtggcatccacttttgtagtaagcatg

SEQ ID NO: 1081 - DNA, 50 bp, Homo sapiens
ctgtccttctggcggagcgtgcttcccgctgcggggacgttcgagcaatg

SEQ ID NO: 1082 - DNA, 314 bp, Homo sapiens
cgttctctggtagcgaccattttggttaatgttgggtgtgtttctgcggtttgtgaggtgagaggcgctggagctatgggtccgaaccgcggtgtctgaacccagaaggtgaagagtccttcttgctgcacagaggcagatcttaggccccgtaacggcgcccgccgctcccggcagtgctttccccgcgtactcgggatggcggcggccgcgctgaggctcccggctcaggcatcatctggctgcaaagaagagaacacactgtgtttgagggaggaggaaggaggatcagagtttaaactcctgccataatg

SEQ ID NO: 1083 - DNA, 97 bp, Homo sapiens
gtttcttccgcttcctgtaccacccggctcaagtagcggacacggaacagggaactatcagcccgtcggcctccgggccctgcattctctagccatg

SEQ ID NO: 1084 - DNA, 88 bp, Homo sapiens
agcccttttcgactgtgagctgcggcagctgagcagaggcggcggcgcgggacctgcagtcgccagggattccctccaggtgacgatg

SEQ ID NO: 1085 - DNA, 465 bp, Homo sapiens
cccccttttcgtttccggcgctcccgccttctctccgcagagctcttctctgagcctgttggggggagggaggggggcgtggaggaactggggttcgcgggagcacgagctgcagcaccacttccgggtgagtgcaaggggagggcagcaaggagggggggccacccactacctcgcgcccccgccctgcgggtgtctcgcgcgcgttccgtgcgtgtgagtgtgtgggtctgtctcgctccagaagtgcgtgcccgcgcgctgcgccttgcgctttttcccctccctcgccccttcctggtcctcccaccctcctcggctccctcctttcccagcaaacgccgcccctcccgcgccctggctcaggctctggcgccgccgcagccgtcgccgcccgaaagttcaggagccctggaaaggagaaggaataagacggcaggaggaagagagagagagggtagaatg

SEQ ID NO: 1086 - DNA, 140 bp, Homo sapiens
ctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatg

SEQ ID NO: 1087 - DNA, 90 bp, Homo sapiens
gctcctcctcccgctcctcctcggcctccccttcgggcgctctcgcgctaactgtgctcctccggggccctccgcctgctcccagccatg

SEQ ID NO: 1088 - DNA, 161 bp, Homo sapiens
gcgcctttatctgcatccgggtccgtgggattcgcgctccactggtcagctggggtcgctctcgggtggttgggtgttgcttgttcccgctgttccagcgtcgaagaaccattgggtctgccggtttgaacttgttctggaagctgtgcgtcaccgtaatg

SEQ ID NO: 1089 - DNA, 34 bp, Homo sapiens
ccgcctcctccgcttgcggccggtctgcaccatg

SEQ ID NO: 1090 - DNA, 106 bp, Homo sapiens
tttcctttccgctcccaggggcgttgggaacggttgtaggacgtggctctttattcgtgagttttccatttacctccgctgaacctagagcttcagacgccctatg

SEQ ID NO: 1091 - DNA, 100 bp, Homo sapiens
ggaccttttcggccaccgctcgcttcaatatggctgcccccagggagagacgaggctaccatgaaggagccgagcgcagaccctgagtccgtcacccatg

SEQ ID NO: 1092 - DNA, 132 bp, Homo sapiens
ctccctcctccttacccccccctccctgtccggtccgggttcgcttgcctcgtcagcgtccgcgtttttcccggccccccccaacccccccggacaggacccccttgagcttgtccctcagctgccaccatg

SEQ ID NO: 1093 - DNA, 215 bp, Homo sapiens
cgccctctagtggcagccggttttgaggccggcctccggctttgaagttcctcaccgcgtctccttccctctccccaaagcctggatcaccgcccagcgtcaggcgaggggcgacgtctcgaggtaaaacggaggaggtgcgggacgcggagactgcgcgggcccggtagccctggagaggccgaggctctaggccgcgaggggcgggtgcaatg

SEQ ID NO: 1094 - DNA, 80 bp, Homo sapiens
agttctctgcggagggccggttgatacagttccggtgggagaacgcggctgcgaggttttcggctttggctcctgatatg

SEQ ID NO: 1095 - DNA, 250 bp, Homo sapiens
cacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatg

SEQ ID NO: 1096 - DNA, 213 bp, Homo sapiens
aagcctcttttcaggctgagtcctaaacctgaagaaagtttagagcctggggctctaaactacctgagtctttccaaacgacaagccaagaagacctgttgaaagtttcctcttaagtttcgtggagagagactcaggtatagaaatatccttactgccacctgacctgaagcagaagaaatcacagacagcttccagaccaggcccaacatg

SEQ ID NO: 1097 - DNA, 96 bp, Homo sapiens
acgccccttctcctgtaaacttgggtcgcctctagcttagcgagcgctggagtttgaagagcgggcagtggctgcacacgccaaactttccctatg

SEQ ID NO: 1098 - DNA, 261 bp, Homo sapiens
cttccttcccttccccgactttgcagatttctcttcccccaggcctccctcctccacctctccgccccctccgggcttggctctcccaggaggctacgactggagccactggtcccgcaggatccccgcgtcctcggtcgccgcgtccacgtccctctcgcgtccccgcccggcgccacgccgcctcctctgggttcggcctccgcgcggtgcagcgcagtctcaggccgcgggacaagcccgacttaaatctctgcaatg

SEQ ID NO: 1099 - DNA, 484 bp, Homo sapiens
cgtccttctcccgcccccgcccctgcctgccagctccaccgggccgtaggtgcggacgacctcaaaattcctcggcccgcgaaggccgccagctgcggggaggggaggggaggcgcggtcccgcagcgcccccaggctcatgtcccaggtatgtccagacccccgaggcaccgcttgcagggcagtgacagcccgtgaggctcggcctcgacccctggcacccttggtcccagctacgccggctcctggccttcccccaagtccgagagagaggtgggattctccccgacgcagttggaaaccgggaatcccctttagggtcccgttcgtgctgcactactgactccaccatctgcaaagggattcttgtccagaatccccgaaggctttaggacagcgcttattttgttgaatgaagagtctctaattttcggaaagaccacaggctaaaagtcaagttgtgcctttttagccaagaagcatg

SEQ ID NO: 1100 - DNA, 82 bp, Homo sapiens
cggcctttcggcagccgaacggccgcggcagttcaggacaaagaggtgtgggcaggccactgggccagctggtaacatcatg

SEQ ID NO: 1101 - DNA, 728 bp, Homo sapiens
tgctcctttcggttgccatagcaaccccattccccaagccctctgtccgtctcctctggtaggttccacaatggtacaggcagcatcacgctgcacaatggtttccaggcagtgaaagagggtgattcagcaagccactcttcttctattttctttaacctccccttcactttttatttttatgggggtgggtggtgcttgctatatgcttacctttttcttttcttttttcatttttacaaatttccttttttgtcctcacccctcaattcctaggggcttgagtgagtttaagattgggttttcttggaaatcacctgtccatcgttaattttaaacaatctccatatctccaaagaatctcttccatgttagtctggaatgtggttaatgaaaaacaagtagggaggatttctggggcaaacactgccggatcaggatcgtagttctcaggcacggaatggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcaggtgtgtgttccttacaggtaaaacaagggattcgataaacaagtggatgtgtcatatattgccaaacattacaacatg

SEQ ID NO: 1102 - DNA, 143 bp, Homo sapiens
cgtcctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatg

SEQ ID NO: 1103 - DNA, 170 bp, Homo sapiens
acgccttttccgctagtcgccccgctctatcccatagtctcgctgccctgagcctcccgtgccggccggccggccgggggaacaggcgggcgctcggggggcgctcggggggcggggggagttccggttccggttctttgtgcggctgcatcggcggctccgggaagatg

SEQ ID NO: 1104 - DNA, 35 bp, Homo sapiens
cgtcctcttgtgtagcctgaggcggcggtagcatg

SEQ ID NO: 1105 - DNA, 90 bp, Homo sapiens
aggcctcttttgaaagatgcggccctgaccctgtgaacctcgcgcagagcggcctgaagcgagaggttgaggctgggaggtgagaaaatg

SEQ ID NO: 1106 - DNA, 102 bp, Homo sapiens
gcccctctacggaggccccgcctctagttcggcctgttttctcagtcccggcacccgccgcgaccgcaaaggcggccgcggttctaggaacttgacgtgatg

SEQ ID NO: 1107 - DNA, 79 bp, Homo sapiens
cttcccttactcaccggtgtccggaaaggtgaacgctgcgctcgggctgcctcgcctgttacctccgccgccgggcatg

SEQ ID NO: 1108 - DNA, 97 bp, Homo sapiens
gctccttttcagctagtgggtggaaccccaggagggaaaactcagggaagcccagggcccgtgttgtgcttttggcccaggtaggtggacagacatg

SEQ ID NO: 1109 - DNA, 280 bp, Homo sapiens
agttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatg

SEQ ID NO: 1110 - DNA, 396 bp, Homo sapiens
cattctttcatactgcctcctcccttgtttttctgtctcagagagatagtctgtcctaaatatcccatgtagcccaggccactgaattaaaacggagcgtattcgttctctgccccaccccgcaactcctgaaagcggcgcaactcaattacttgatccttatatgccccacgcgggactcatactacgtttcccgtgaacacgtgcagtccaaaccccgcccctgatatttatctcagtggacggtggccggaaaaggacaatggtttccatgtcagcggataaacgctctcccctcggctcccggacgcgacggaggtcgtagtagtagtgagtacgtgctgaggagcaaaggagtaaccaagagatccagtgaccgacagagcaagagccatg

SEQ ID NO: 1111 - DNA, 132 bp, Homo sapiens
tctcctcctttgcttcataaaaagagggacaagtggctggtgctgtggacagagaagctttatttttagtatgagacaacctctattttctttcaggagagggaagttggattatcaattcttttgtaaatg

SEQ ID NO: 1112 - DNA, 103 bp, Homo sapiens
ccccccctttcccccttcgcctcctgacaggaaaggtttaagggggacagagccctgggaggccgggccgggctcgggggccaccccgggggcccgggccatg

SEQ ID NO: 1113 - DNA, 119 bp, Homo sapiens
ggttctctgctctggacttgggaggctccgttgcctgctcccggagggagacgcgctgccgaggagaacccagcgggagaacatttcaggataggaataggccaagtgctgagaagatg

SEQ ID NO: 1114 - DNA, 225 bp, Homo sapiens
ccatctcttccagcaggagagggctctactctgagctcctattttccaaggctccgggccgcgctcggcgctggcctgctgccccggcgggtccgccggccggaggcgggagtcacaggaagagccctccacaaaaggaggcctcggcggatcaggacagctgcaggtgggtgtgcagactggtgagctgccagcaggggcccagacgcgccaggcctggagatg

SEQ ID NO: 1115 - DNA, 105 bp, Homo sapiens
cggtctctcagcggccggtttctgcgtccgctgccgcaggttccaccgcgctccaggtatttttttttctgaaggaaagctgcttcctcatatgtttcaagaatg

SEQ ID NO: 1116 - DNA, 271 bp, Homo sapiens
cctccttttccgttgtcccttcgcgccccaaaccacatcctggagcgcactctccagcgtggctggcagcggggacggtgcgccggggcgcaggcccaagagtcgcgtgcgcggccccttgcaccatccccccgggcccacccccgggccgcgctgattgggcaggtagggactctgcccagcggaaagttttgggtgccgggaggaagtctaacctttgggagactccaagacagcagctccgaggtcggcgggggtctgggtggccatg

SEQ ID NO: 1117 - DNA, 252 bp, Homo sapiens
acttcttttccgtgggagtaaggaagtgcttttgaatgaggtactgagggccaaggtgttggaagttcctaattctttcctcggttaactgtgaaactctgcgtattgggaaggcctggcctcagtcatcaggccaggagaggtactggacgccgcgcacgcactcgtctgccagcgaggcccaaaggggaagcctagcggagctcagtgtggcagctgctggcctctgggccgctacttgtcaataccatg

SEQ ID NO: 1118 - DNA, 638 bp, Homo sapiens
ccgccttcctcctcctcctctcgccgctaccgccgtcgccgccgccgcagccgccgccggtccgcgcggcctcgggtggccggagctcagcctgcgcgcgccgcgccctgtgtctccgggtggggcagaagactcgccccttgaacctcccgcggggactctccgtggtgtggcggccctggggctctttcttaatagccccggactgagtcccctccagtcgaggaccctctcctagtccactgacgagcggtggacacctgccgctgtatctcccccaaaccgagtccttgccctgctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatg

SEQ ID NO: 1119 - DNA, 107 bp, Homo sapiens
cactcttctttagcatgctattatggggaaagtgaccactcctgggagcgggggtggtcggggcggtttggtggcggggaagcggctgtaacttctacgtgaccatg

SEQ ID NO: 1120 - DNA, 90 bp, Homo sapiens
cttcctctgctctgcttcccttcggaggaaaatttcaggctgaaggtttagcgggtgccgcctctaaagagagcaatcactacacttatg

SEQ ID NO: 1121 - DNA, 271 bp, Homo sapiens
gctcctcttcctgccggcatccgggatccctacgtcccgcgtcccccgagcgctcggagcctacgcgcccagcgctaccgaaacccagagtcctgcgccctggagtccccgcgccccggagcccgagcacccgggagtcccgagcctcgcgccccggagtgcccgagcctgcgccgccgcacccggataccccgcgtccccgcgagctgccgaggccgcccgccgccgccccgcggacagtaccgccttcctcccctctgtccgcgccatg

SEQ ID NO: 1122 - DNA, 159 bp, Homo sapiens
ctccctccctagctgacttgctccctcccgggctgcggctgctgcaaaagccagcagcggcagcgggagctgtccggaggccggcgtcgagggtttgccgctgtctctgctattccatcctccccataggggctctctcccctctcccatctcaagatg

SEQ ID NO: 1123 - DNA, 136 bp, Homo sapiens
cggcctttgtctctcgctgcagtcagagctccaggtctggttcttctcctaaaggcccaggctgtgtggccccgtgtcctgcaggtattgggagatccacagctaagacaccgggacctcctggaagccaaaaatg

SEQ ID NO: 1124 - DNA, 31 bp, Homo sapiens
cggtcttccgggcccgggtcggggctcgatg

SEQ ID NO: 1125 - DNA, 78 bp, Homo sapiens
ggctctctgacgaaggactggaaggtggcggtggtgaaggtgcaggccgttggggcggctcagaggcaggtgactatg

SEQ ID NO: 1126 - DNA, 148 bp, Homo sapiens
ctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatg

SEQ ID NO: 1127 - DNA, 93 bp, Homo sapiens
ctttctctttgtcggaggagctcctctgtttcctgtgcagtagctcccgttgcggcggcacccgtggcagccctggcggacgcaggagcgatg

SEQ ID NO: 1128 - DNA, 248 bp, Homo sapiens
ctgcctctcctcggccaggcggaacctctctgctgggcccggtggccgcaaaagaactttctttctcccgcccgaacggtcgccgcggccaactgcctcgcccgcctggcagcctaaccctccttctcttcttctcctctccggcttcgcgcggccctgcctccctctcgcccggcggcatccgcttgctgctgccaccgcctcctcatcttctgcccggccaaccggcctgccccgctgcagtgatg

SEQ ID NO: 1129 - DNA, 495 bp, Homo sapiens
ccctcccttgcactgcctctggcacctggggcagccgcgcccgcggagttttccgcccggcgctgacggctgctgcgcccgcggctccccagtgccccgagtgccccgcgggccccgcgagcgggagtgggacccagcccctaggcagaacccaggcgccgcgcccgggacgcccgcggagagagccactcccgcccacgtcccatttcgcccctcgcgtccggagtccccgtggccagggattattggacctgcctggtttaaactattgtcttagttaattttgtgctgctctaacaaaatatcacagactgagtaatttataagcaatagtagcttatttggctcacagttctggaggctgagaagatcgtgaggctgcatctggcaagggccttcttgctgcttcataacatggcagaagacatcatgcgggtgtgtgtctggggaagagacttacagaagtggagttgctgagtcaaagatctaaccatg

SEQ ID NO: 1130 - DNA, 164 bp, Homo sapiens
ttttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatg

SEQ ID NO: 1131 - DNA, 33 bp, Homo sapiens
cttcctcttcgttaagtcggccttcccaacatg

SEQ ID NO: 1132 - DNA, 256 bp, Homo sapiens
cgctctttttaagctcccctgagccggtgctgcgctcctctaattgggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatg

SEQ ID NO: 1133 - DNA, 173 bp, Homo sapiens
cggcctttgcggttgatcggtcattggggtgctgcagccccgccacctgttccgtagcttgccggtgccccgaaggtgtcttctcctaaggaagattaaatcagaaaattttaaatcacagttatccctttacttaaagccagagtaagccttccaaattaaccccaggaatg

SEQ ID NO: 1134 - DNA, 485 bp, Homo sapiens
ctttctcttctcttagcagcacccagcttgcccacccatgctcaagatgggcgggatgccagcctgttacataaatgtgccaaaagcctggccatgcctggaaaatggaccaatccgcccgccaagaggttgggtctcgttccctagagagaaggaagtttcctctccttgaagtgagagctagaatcgcactttctgtcaagctgagagaaagactcttttccagaggctaaaaggacaagaaaatctgatttgcttgcttctaactttgcgttttaaagggggaaggaggaaaggaaagagggggagggtggttctgcttagccccacccctccggctaccccaggtccagccgtccattccggtggaggcagaggcagtcctggggctctggggctcgggctttgtcaccgggacccgcaggagccagaaccactcggcgccgcctggtgcatgggaggggagccgggccaggaacaatatg

SEQ ID NO: 1135 - DNA, 79 bp, Homo sapiens
ccgcctccccgcgggttccgttggctgtggcggcagctgacgcttgtggcggcggtggcttcggggtgggcgtaagatg

SEQ ID NO: 1136 - DNA, 115 bp, Homo sapiens
tgttcttctacttacctgggcccggagaaggtggagggagacgagaagccgccgagagccgactaccctccgggcccagtctgtctgtccgtggtggatctaagaaactagaatg

SEQ ID NO: 1137 - DNA, 101 bp, Homo sapiens
ggtccttcacgttccattcccaggctggtctgagctccggggccgtggtcccgctgcctcctccggtcgtcgtgcggaagctgcgacgcaggcagaccatg

SEQ ID NO: 1138 - DNA, 87 bp, Homo sapiens
cattcttccggtggagatggctgcggccgtggcggggatgctgcgagggggtctcctgccccaggcgggctagagtgcagtggcatg

SEQ ID NO: 1139 - DNA, 94 bp, Homo sapiens
acttctctgtagatcgctgagcgatactttcggcagcacctccttgattctcagttttgctggaggccgcaaccaggcccgcgccgccaccatg

SEQ ID NO: 1140 - DNA, 134 bp, Homo sapiens
cggtctttctctagacgcgtcttgctgggagagtgtccgttgcttcccgtccgtgtcgcggccctgcggttggcggcctcctcgtggagcggagcaaggccaggcggcccctgctcgagtcccgcgtcgccatg

SEQ ID NO: 1141 - DNA, 301 bp, Homo sapiens
gggccccctccgcgcgtactgcgggccccacgggtgttagtggcgggggcggcagagtccgggtgggttgtcgcgacggagccgggcctcttcgccgtcttgagacggggctggcgagaagggcccctcacggagttgccatgggcgtctaaccgcggcagccaggcccctctctacgtgagaccccggcccccctcccctttctgcagcccgcccgccacctgcgcgccgcgtggcctccgccggcgcctgcccgccccgcgcctccgtctcccacggagcaggccgggctctcgccatg

SEQ ID NO: 1142 - DNA, 204 bp, Homo sapiens
ccatcttttccggcgctggctcctctccgtcagtgcggtttcgcctttatggtggtggagtctgcccaggctgtggaccgcaaataaccctgtacaaagaggaatggagattgcctctatccacctagattcataagctggcctgaggtgatcttggcatcaaggaagggatgcacatcatcacaccatcagcttcagagaatg

SEQ ID NO: 1143 - DNA, 117 bp, Homo sapiens
ctttctcttcttttgcttctagttaccatcctcaaaggattggctaaaagcaagcaactggattgaacaccctaagaagaaagattcacactgcaccaggagacatcagaaagaatg

SEQ ID NO: 1144 - DNA, 134 bp, Homo sapiens
gcgcctttcgattgcatcagctggtccagccgaggccaagtcccgggcgctagcccacctcccacccgcctcttggctcctctcctctaggccgtcgctttcgggttctctcatcgcttcgtcgttcgccaatg

SEQ ID NO: 1145 - DNA, 158 bp, Homo sapiens
cagcctctgtgcggtgggaccaacggacggacggacggacgcgcgcacctaccgaggcgcgggcgctgcagaggctcccagcccaagcctgagcctgagcccgccccgaggtccccgccccgcccgcctggctctctcgccgcggagccgccaagatg

SEQ ID NO: 1146 - DNA, 174 bp, Homo sapiens
cgtcctctcagtggtagcgcggggactggctgggaagcggtcggtcgagtgtggcctgtgtggactcgcatcttgcccgaagccgggcggaggagagctcaagctaagggtgatcagcccatgacctaaacctccagacaaaataaaacggaaaatttgctagaatcaagaatg

SEQ ID NO: 1147 - DNA, 112 bp, Homo sapiens
tgaccttttcattcccgttgttatggaggtaggctctctaggaatctgggagtagtagctggggggcaagagcaaataaagagctcgagcttctgtggtctctggggagatg

SEQ ID NO: 1148 - DNA, 1859 bp, Homo sapiens
gggccttctggcagtttctgggagctgcgaacgcgccgccccggggctcggcggccggaaacgctggcttcggagccttaggcgccgcggcctttccttgttttccgcccagtccacgccgccatggccaagtggggccaggggaacccccactggatcgtggaggagcgggaggacgggaccaacgtgaacaactggcgctggcgcggctggcggcggcctccttccgggatctggggagggccgggccgcgggagccggggctgccctggggtctgtgcggggccgcggggccagggggtcagggggccgccccccctcagctgctggacgcagggctcggccttcgcctctcggctcgggagagtccttgagtacggagaccggctaggagggttgcagctgcctctttttgaaagttgggttgggccccaagagtgacttccgacagacctttccactcccaccgtctgtggcctgagggccttcccttctcctcccgcccacccctctggatgtttcggggagttagaagggagctggattgagagactgtgttaggggcgggggtatggaacgtagtggaaagggcagaaatttggatctcagttcgcgcccaccccgcaggcgcctcccgcgagccgggccctctgtgagtgagacaagctccccttcctttacgcgcctcacctggcgcgtggggagaggtcggcagccctccgccgcagaacctccggaagggatgtcctctgccctgcgcctctggccggggctgtggtccctccaggccgtcgaggggatgctgaggccggtccccagaggagcatgacttggctggtccggaggagctctgagggcatgggcaatcttggctcgctgcaacctcagcttccagagttcaagcgagtctcctgcttcagcctcatgagtagctgggactacagatgcgtgccactacgtccgtctgatgtttgtatttttagtagagacagggtttcaccatgttggtcaggctgctctcgaactccagatctcgtgatccgcccgcctgggcctactaaagtgctgggattacaggcgtgagctagatctgactttctagtgtcctagccttggcccgatggacatgtcatttctctcagctcgtttctgtcccctaaagtgagaatattgcctgggaagattacattagacgatgtatatgcgaagacacttgatagctggtattgtcatgattctgattagttcactactgctactttccctgtggcctaggctttgcctatttccagtgggcgagctagctagatcctcctcccttaaataagccagtgtttttaagacagaatactacttgcatagtggacaataatatcttaaagaactgagcaggatgaaaagaatttgatagaaagcaggtttgaggagcacattggaggttggcaggtttcgaggctgcttgagaggacttgggccgatctgggctgggcttggacgtgaccctggcacccaggcaggtggatcccagctggggcttccattcacgactttctggtccctggcaggacagagcgggatgccaccagcttgtccaaagggaagttccaggagctcctggtgggcatcgttgtggagaatgacgctggccgcggcgagatcaacgagttgaagcaggtggaaggggaggcttcgtgcagcagccgcaaaggaaagctgattttcttctatgagtggaacatcaaactgggctggaaaggcatcgttaaagaatctggagtgaagcacaagggattgattgaaatacccaatctttctgaggaaaatgaagtagatgacactgagaatttacaacgggaatg

SEQ ID NO: 1149 - DNA, 28 bp, Homo sapiens
ctgcctctcagcccaaattggaaacatg

SEQ ID NO: 1150 - DNA, 115 bp, Homo sapiens
ccgcccctttcatggccgccgcctggcgccggggctaagtggccgccggcgtccgggtacccgagggctctcccgcgttgctggcaccgctggcgccgcggtctcgtagcgcatg

SEQ ID NO: 1151 - DNA, 110 bp, Homo sapiens
cctcctctggctgctgcctccgcagctccctcctcctaccccacctcctccatctggggagcgtctgcgggggcctgaggggcggcggcggcggcggcggctgcgatatg

SEQ ID NO: 1152 - DNA, 98 bp, Homo sapiens
ccctcctttgcgctgggctgagcccagagccgagagcaggggtcggctctgagttccctgcttggtttttgggtggcagcagccagaggaggaatatg

SEQ ID NO: 1153 - DNA, 112 bp, Homo sapiens
cacccttctctgtctacctctgggcgggactgccgggtgatgagatactcggtcggcgacggtagaacgggcgacggcgacaaccgcaatcacatccacgacggtgatcatg

SEQ ID NO: 1154 - DNA, 213 bp, Homo sapiens
ggcccctttcggtccaacggcaggacctgggggctgtggccgggggcggccgttgacctggtgaccgcggcgccgccccagaccgggggcgcagtcccactcgctccgagccccggtcccccaagcctccctcccgggtacctggggccgcgcccgccctgcgcccagctccgccctccgtcggcccaggcctgacagagcccggcagccatg

SEQ ID NO: 1155 - DNA, 294 bp, Homo sapiens
cttcctctctagccgccagtgctctatgctccgcggtcgcgggccgccagcctccagccggccagccgcgaggggtgcgcagagggaggcggggcggaaaggcgagaggtgtctcctccaccggagccaggggagacccgagcaagctccgtgacagcacgtcggccgccatgtcgccgagtggggctggaaacagacccggcgcccagcggtagccctccttgcgcctccgattcccagacatggaaggtctttaatgtaactttaaatggttcaccaaaggatgctctaatg

SEQ ID NO: 1156 - DNA, 154 bp, Homo sapiens
gggcctttgtctctcgctgcagccggcgctccacgtctagtcttcactgctctgcgtcctgtgctgataaaggctcgccgctgtgaccctgttacctgcaagaacttggaggttcacagctaagacgccaggaccccctggaagcctagaaatg

SEQ ID NO: 1157 - DNA, 66 bp, Homo sapiens
cccccttctctttcagcctcgggcacgggggaggctcggcggacctgctgattgggaaccgatatg

SEQ ID NO: 1158 - DNA, 137 bp, Homo sapiens; identical to SEQ ID NO: 689

SEQ ID NO: 1159 - DNA, 437 bp, Homo sapiens
acctccctcccctcccaggcgccgccgcagccggagcggctcccgggccctgggccgccgccggccaggaagaaatacttgtgttggctgcatttccagggatgctaccagagctcaaggctgtcacctggtcttgcccagaagagccgttcttagaggcaggacttgatgaaggctttcctgctgatggaataggtttgctagagctggccttggaattagaacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatg

SEQ ID NO: 1160 - DNA, 68 bp, Homo sapiens
cctcctctgtggattctggccaggccgggttcggcggttgctgtgagagcgggcttcccaacaccatg

SEQ ID NO: 1161 - DNA, 595 bp, Homo sapiens
aggcctctctgccgcgcgcgcaggtacggggcagaagtcgcaggtacccagctgctgcccacatttctggtccagagtcccgaaccccgagcactgggatgcctggctactccgagccaaggcactgatgtttgaactggaaacttcaaaacgtttaataagagtcttcaggatgggtttgaactagacaagctagaaatttctttagaacaccagctctagcatgcatctcccacttttggctttcctggagaggagcttgaagaggtggttctgcagacagccacagtgatacttaggaaaccagaggaatggatttgacttttctgctaggattctctgttatagtttctccctgagttgtaagaggcatggaaatatacatgaaactgaagaacctgcaaggaagggaagtggaactttccatgctgagtgaaaactaaccaagtggcagttgtgactgaaaacactgaaacctaccacgtccagattcactggattgggggatagaggaacggtcacagctagggagaaagaagtgataccggaaaagaaaacctaaatgaagagaatgaggatgactgcacagtagatg

SEQ ID NO: 1162 - DNA, 28 bp, Homo sapiens
agctccttttcctgagcccgccgcgatg

SEQ ID NO: 1163 - DNA, 311 bp, Homo sapiens
agttctcctgggcgcctagcattgtcgcccacgctgcagtagcggcttctgcggctccaagccagcgggtcctgtgaaggcgagcagacgcggagaaaggacgcgggagtgagagagggtgagtcagccactgtctaaacgataacgggaggcggctctgcggggtagggttgaattcagtaaatgggctcgtgctgctgtctcttcggagacgctgctatcttagcgtcagcgagggaaggttgaggaggagccagagccgggtcctgcagcgtttctcgccatcagcgcccgtcgccatctccaccatg

SEQ ID NO: 1164 - DNA, 127 bp, Homo sapiens
ctttctttgactggagcggacccgccggacgcaaccgcctcgccagccggagccagcgcgagctcggcacggtggacacccggtccgaggccggcaagccggctggtgcccgagtcggccaagcatg

SEQ ID NO: 1165 - DNA, 137 bp, Homo sapiens
ggtccccttatttggatctgcgggaatgtgggctggagaggtcctgccgtggtaccagcctccagcctgcccccaggactgcccctgacccaggcgcgcccgctgctcggtggcaggagggccggcggagcgccatg

SEQ ID NO: 1166 - DNA, 90 bp, Homo sapiens
gattctctttgttccgcagccatttcaggccccggacaggaggcagtgccgcttcggccgaaggcccgagcgcccgaggcgtctgggatg

SEQ ID NO: 1167 - DNA, 43 bp, Homo sapiens
cttccttcgttattggagccaggcctacaccccagcaaccatg

SEQ ID NO: 1168 - DNA, 329 bp, Homo sapiens
ggctccttcctccaggagtctctggtgcagctggggtggaatctggccaggccctgcttaggcccccatcctggggtcaggaaatttggaggataaggcccttcagccccaaggacatcctggctgccatacctgctcctgacttctcagggctggcagtcatcgactgggaggcatggcgcccacgctgggccttcaactgggacaccaaggacatttaccggcagcgctcacgggcactggtacaggcacagcaccctgattggccagctcctcaggtggaggcagtagcccaggaccagttccagggagctgcacgggcctggatg

SEQ ID NO: 1169 - DNA, 182 bp, Homo sapiens
agtcctcccggtcgccccactgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggcctacacagtaggaactcatg

SEQ ID NO: 1170 - DNA, 113 bp, Homo sapiens
ccctctctttcgctgtttgagagtctctcggctcaaggaccgggaggtaagaggtttgggactgccccggcaactccagggtgtctggtccacgacctatcctaggcgccatg

SEQ ID NO: 1171 - DNA, 79 bp, Homo sapiens
ggctctttccagctcctggcagccgggcacccgaaggaacgggtcgtgcaacgacgcagctggacctggcccagccatg

SEQ ID NO: 1172 - DNA, 115 bp, Homo sapiens
cagtcttttctccttgctcagcttcaatgtgttccggagtggggacggggtggctgaacctcgcaggtggcagagaggctcccctggggctgtggggctctacgtggatccgatg

SEQ ID NO: 1173 - DNA, 145 bp, Homo sapiens
atcccttcctctcttttctgttcgccctcttctccctgctctttttccctttccacccccctcctctgttctccctcacctcctgcgccccctcccccttcccgggttctgacagtacgatgagctgccccattacggcgggatg

SEQ ID NO: 1174 - DNA, 169 bp, Homo sapiens
ttttcttttcgtttagatacattgccttttgcctaggctggcgtcgagacttgaggccgttgcagactttggcgcggctcgcgcctcctgcttcaagagcccagcggtgagagctggcctgcggcacgcggcctaatgccagacagtaacagtttggaggatcaagatg

SEQ ID NO: 1175 - DNA, 238 bp, Homo sapiens
gagcctttgccccggcgtcggtgactcagtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatg

SEQ ID NO: 1176 - DNA, 677 bp, Homo sapiens
cgctctttctctcgccgcgccgtcttgaagccgcgcgggctcgtgagcagcgcgaggccgccaaggtgcctcgcttcgccggagccgctgccgcccgccggagggaagccggcctcgggcgcgcacgctcgtcggagccccggcgcgccccgcgcctgagcctgctgacagcggccgctgggctcaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatg

SEQ ID NO: 1177 - DNA, 95 bp, Homo sapiens
ccgtctcctcctcttgctccctcggccgggcggcggtgactgtgcaccgacgtcggcgcgggctgcaccgccgcgtccgcccgcccgccagcatg

SEQ ID NO: 1178 - DNA, 796 bp, Homo sapiens
ttttcttttcgccaggggttgggactccgggtggcaggcgcccgggggaatcccagctgactcgctcactgccttcgaagtccggcgccccccgggagggaactgggtggccgcaccctcccggctgcggtggctgtcgccccccaccctgcagccaggactcgatggagaatccattccaatatatggccatgtggctctttggagcaatgttccatcatgttccatgctgctgacgtcacatggagcacagaaatcaatgttagcagatagccagcccatacaagatcgttttcaactagtggccccactgtgtccggaattgatgggttcttggtctcactgacttcaagaatgaagccgcggaccctcgcggtgagtgttacagctcttaaggtggcgcatctggagtttgttccttctgatgttcggatgtgttcggagtttcttccttctggtgggttcgtggtctcgctggctcaggagtgaagctacagaccttcgcggaggcattgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggatgcagctaatatacccagttggcccaaagcacctaacctatagttatataatctgactctcagttcagttttactctactaatgccttcatg

SEQ ID NO: 1179 - DNA, 59 bp, Homo sapiens
gtccctccttccctccccgactgtgcgccgcggctggctcgggttcccgggccgacatg

SEQ ID NO: 1180 - DNA, 309 bp, Homo sapiens
cactctctttctctctccctctggcatgcatgctgctggtaggagacccccaagtcaacattgcttcagaaatcctttagcactcatttctcaggagaacttatggcttcagaatcacagctcggtttttaagatggacataacctgtacgaccttctgatgggctttcaactttgaactggatgtggacacttttctctcagatgacagaattactccaacttcccctttgcagttgcttcctttccttgaaggtagctgtatcttattttctttaaaaagctttttcttccaaagccacttgccatg

SEQ ID NO: 1181 - DNA, 173 bp, Homo sapiens
agcccttttactcagccacagcctccggagccgttgcacacctacctgcccggccgacttacctgtacttgccgccgtcccggctcacctggcggtgcccgaggagtagtcgctggagtccgcgcctccctgggactgcaatgtgccgatcttagctgctgcctgagaggatg

SEQ ID NO: 1182 - DNA, 666 bp, Homo sapiens
cttccttccttctccagtcccttccactgtgcgtcttctgtcccccgttcttccccagcggacccctctttcgagactccctagtggggtccccagctcccgggcgatcctgcccttgccgagcgcgttttctggagtcacctgggggaggggagtcctgggcagggccgggctggggaagacgcctggggcactgcccggcgttaacaaagggagccgataccgaccggcgtgggcgcggagcgggcggccgccaccgagcgtgctgagcaaccgcagcctccgcggccgagagtgcagcgagcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgagatgagttttgatcatcctgagaaaaatgggccttggcctgcagacccaataaaccttccctcccatggataatagtgctaattcctgaggacctgaagggcctgccgcccctgggggattagccagaagcagatgatcatgacgcagtcctgaggtttaatggggcacccacagccaacttccaacaagatgtgggcacaaaaactaccattcgcctgatg

SEQ ID NO: 1183 - DNA, 60 bp, Homo sapiens
ctccccttccgcgcccggctccccttccgcgcccctcccgccggagatgaggggaagatg

SEQ ID NO: 1184 - DNA, 37 bp, Homo sapiens
gcttcttttgctgggctgctgctccttcggcatcatg

SEQ ID NO: 1185 - DNA, 420 bp, Homo sapiens
cggtcttccgggtgtctttgacagggttttctacgccgctttttcggcgactttttgctcttccgctttttgccaccgcccccaaccttctatatccttgcagcccctaccttttcttgtgttgctcctcccctggcagccgtgaggggggttagatctcagccggagccggagctgggcctagctgtcccacgggccaccactacctcctttggttcgggagaaagctacgaccaagtacgcccagctcgggccttagaacttctgaacgggcagtgcgggtaggccctgcttagcccttcccggaggacacctgaccaaaagaggaagatagtcttgggacccttgcatggtgtttcaaagggtggtgaagaactaaggtagaagaatacatgttcacttccagtgaacaagagcatg

SEQ ID NO: 1186 - DNA, 120 bp, Homo sapiens
ctcccttctggtgtactgggtgggaggtggaactagtcggacaaagccctcgcgtcggacccttgccagaactcaattaatggatgcctcgaagttgacgtacatatatattcagaaatg

SEQ ID NO: 1187 - DNA, 230 bp, Homo sapiens
cgcccctttgcgcggctggcgcggccagccggccaggctcccctcggcaaacctgtctaattggggcggggagcggagcttcctcctctgagggccgtgccgcgctgccagatttgttcttccgcccctgcctccgcggctcggaggcgagcggaaggtgccccggggccgaggcccgtgacggggcgggcgggagccccggcagtccggggtcgccggcgagggccatg

SEQ ID NO: 1188 - DNA, 114 bp, Homo sapiens
ctacctctacccacagccagtgcctttggcgcactgaggtgcacagggtcccttagccgggcgcagggcgcgcagcccaggctgagatccgcggcttccgtagaagtgagcatg

SEQ ID NO: 1189 - DNA, 162 bp, Homo sapiens
cctcctctcgctctctgcccgctaactttcccgagccccgaccggcggcgcagagctccggggtagctttgtggccgaacgccgacctcgggcggagagcgcggctgtgcccagtatcccatccccgcgacccccgcgcgctccggagagaacaggactatg

SEQ ID NO: 1190 - DNA, 206 bp, Homo sapiens
tcccctctgcctcccggtggctcctcgctctccttccatctctctcgccccctctccctccgtcccgtcctcgccgctcccctcaccccgcctctctccccctcccccagcccctcctctcctcaccccacccggcctccctccctccctcgcccgcccggcgctcgcagagccgacaccaggggggctctcgatgtagcaccatg

SEQ ID NO: 1191 - DNA, 119 bp, Homo sapiens
ttcccttccttggatccctgtgcacctactggagccaggttactctgggtcctggacctgactgcctcattctggaggcttccagacagccacagttagtgcccaaacctgagaggatg

SEQ ID NO: 1192 - DNA, 52 bp, Homo sapiens
cgccctctcttcctgcagcctgggaacttcagccggctggagccccaccatg

SEQ ID NO: 1193 - DNA, 248 bp, Homo sapiens
cattctctttccttttccttctctcctgagcgctcctgcagttcctggggcgtagtaggggatccacaagcgtttgtgaccagtgaagttctttacaagggtgagatctgcacgggaggacccgagcgagggtctcggcttgccaggaagccggggttccccgggaagcgtggagttcacccgcgcactcgaagtgcctttgcaaaattatatctgggtgttggcacccagccactattctgccaatg

SEQ ID NO: 1194 - DNA, 89 bp, Homo sapiens
agctcttttccttcttcctccacttcccctaccctccaccgtccgggagccgccgccaccgccgccgaggagtcaggaagttcaagatg

SEQ ID NO: 1195 - DNA, 693 bp, Homo sapiens
gcgcctttgcggccgtgattcggtcccgctgtcctaggcgggatggtgccgctgtgccaggtaagggtggcgggtgtgcgtgcgggcctgggtgcggagccctcctcgacgtgtctctcccgccctttccctccacatacccagccttggtcagtcggacctccccactagcccccaacctggccggcgtcttgggttcgggggcgcccccgcccccgcccccgggcccttcctgtctccgggctttactgcgactgccccagcagaagtcgggtcctctccgagaactcttgtcagctcacggcagcaaggacggactcgttctgaaggcgcctccaccttttatgaccacctctttcccagattattcgttttgatgaagctaaaattttaatctaaaaagaaatgcacctcatggagaattcttgtgaagaactgtgcttcatctgtggatttctacacccttgatcatttgcaaacctgtaattatttcgtaaagagttgtttgcacggagtgacaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatg

SEQ ID NO: 1196 - DNA, 24 bp, Homo sapiens
tttcctttttccggaggggagatg

SEQ ID NO: 1197 - DNA, 45 bp, Homo sapiens
ctgcccctcactcgtctcgcccgccagtctccctcccgcgcgatg

SEQ ID NO: 1198 - DNA, 512 bp, Homo sapiens
agtccttcttgtcctggtcgttgttcccgtctgagtaccagctccccactgccctgagggcgggccggcctgcggcggagggaaaaaggaagaggagaaggaaattgtcccgaatccctgcagtgggtccaagcctctcccgggtggccagtctttctgtaggttgcggcacaacgccaggcaaaagaagaggaaggaatttaatcctaatcggtggaggtcgatttgagggtctgctgtagcaggtggctccgcttgaagcgagggaggaagtttcctccgatcagtagagattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatg

SEQ ID NO: 1199 - DNA, 518 bp, Homo sapiens
cgtcctcctctgggtaccaactctattgcgcagctcgctgccgtgcgtttaacccaggcgaggaggaggaggagaaaattcccccagattcgggcaggcccgcaccccacattccgtcctgttttgagaggaggagggaagagaaataaacgtggcagcgcatagaaggccagcagggagactgctttccagacacctccggcccacacagccgttcaccccccgtcttttcagtcctggaaaaggaattcggtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatg

SEQ ID NO: 1200 - DNA, 537 bp, Homo sapiens
cgccctctggggctccgagcccggcgggaccatgttcaccagcaccggctccagtgggctctgtgagtaccggcctccgccatcctggctgccccctacacgccaccctaggcacctctttgaggaggctggggcagcggggaccctcgggtttgccggaggtggtggggccgaccctccagacccgcgtccgaaccctgctagttcccggtcttgggggtcagcggaaaccgcccccatttcggcctggaggggcgaatggggacaaagccccgccgcccgccccgaccccacctggtatccccaggtgctctgcccaggagtctcttggggccgctgcaagtgggcaggtgccctggtgttctcgtgggccggccccaggccctttgcggagcgtgtgccgcgctgaaggaaggggccgtcccccttaccatgccccattcttttaggcttgggggaccgaactaactccccccgcccccacttgcaaagttcagcctccgctttagaagctgacctctcagtttcacttggatg

SEQ ID NO: 1201 - DNA, 119 bp, Homo sapiens
cctcctccctcggccggccctggggccgtgtccgccgggcaactccagccgaggcctgggcttctgcctgcaggtgtctgcggcgaggcccctagggtacagcccgatttggccccatg

SEQ ID NO: 1202 - DNA, 181 bp, Homo sapiens
cgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatg

SEQ ID NO: 1203 - DNA, 130 bp, Homo sapiens
ctttctttttaaaaatcgctgggtctgttgagctgtcctgggctgggtgccttgctctttgactgagactggagacagacggcaacagccacaggcagactgaggtggcaataggaaatctgccgagatg

SEQ ID NO: 1204 - DNA, 239 bp, Homo sapiens
gattctcccgcctcccagccccggcgcacgcgcgccccgcccagcctgctttccctccgcgccctcccctctcctttctccctctcagaaccttcctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatg

SEQ ID NO: 1205 - DNA, 146 bp, Homo sapiens
tttccttcttcccgcgagtcagaagcttcgcgagggcccagagaggcggtggggtgggcgaccctacgccagctccgggcgggagaaagcccaccctctcccgcgccccaggaaaccgccggcgttcggcgctgcgcagagccatg

SEQ ID NO: 1206 - DNA, 235 bp, Homo sapiens
ttttctttctctcagcatctccacccaaccagcagaaaaccggtgagtggggcttttaagtgattttcaagaagaatgtaacagatgtcaaacgggaaaagcacaaggcaaagcctgctctctctgtctctctgtctcctcttctccttttttgccttattctatccgattttttccctaagcttctacctgggattttcctttggaaaagtctctgaggttccaccaaaatatg

SEQ ID NO: 1207 - DNA, 82 bp, Homo sapiens
ttgtctttttttttttaaactaaaatggaggctggtttcttgccttaaggagcccattgcctttcccgctgaagtctagatg

SEQ ID NO: 1208 - DNA, 440 bp, Homo sapiens
ccacctttccgggggaagccacgcgcaccaggcatcgcacgcggctctgcacccgcgccgccggacctgaaacccggcggagggcacacggggctgccgctgcgggccccggaccaacccatgcttactccggagcctgtaccggcgccgacgggtcggacctccctgcgcggtgtcgcccagcgggttcgtgcgaaaggcggggccgactacacgcggtgccgcgccctgagaccgtttatctgcagtcaacgcagcctcccggctcagcctgggaagatgcgcgaatcgggaaccccagagcgcggtggctagaccgggctccgccgcctcccccacagcccctttcctaatcgttcagacggagcctggtcgacttcgccggagactgccagatctcgttcctcttccctgtgtcatcttcttaattataaataatg

SEQ ID NO: 1209 - DNA, 257 bp, Homo sapiens
caccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatg

SEQ ID NO: 1210 - DNA, 555 bp, Homo sapiens
cctcctcttcctccccactctgcacatgcggctgggtggcagccagcggcctcagacagacccactggcgtctctctgctgagtgaccgtaagctcggcgtctggccctctgcctgcctctccctgagtgtggctgacagccacgcagctgtgtctgtctgtctgcggcccgtgcatccctgctgcggccgcctggtaccttccttgccgtctctttcctctgtctgctgctctgtgggacacctgcctggaggcccagctgcccgtcatcagagtgacaggtcttatgacagcctgattggtgactcgggctgggtgtggattctcaccccaggcctctgcctgctttctcagaccctcatctgtcacccccacgctgaacccagctgccacccccagaagcccatcagactgcccccagcacacggaatggatttctgagaaagaagccgaaacagaagatgaggcaatgaggctgcgagaggtagagtgattttccctcggtgactcaactgggacgtagcaggtcgggcagtcaagccaggtgaccccatg

SEQ ID NO: 1211 - DNA, 295 bp, Homo sapiens
tggtctttccgggtccttgcacgcttcgctccaactcctgcagagctgagccggaggggaatccggaagggacacgctgaacaggtctgactcccgggcagcacagcccgctcacgattccggccacggtgatgacgagtctccgtcaacctcgtctggcacagctgggacctcctctgtgccagagctacctgggttttactttgaccctgaaaagaaacgctacttccgcttgctccctggacataacaactgcaaccccctgacgaaagagagcatccggcagaaggagatg

SEQ ID NO: 1212 - DNA, 138 bp, Homo sapiens
ccgcctcttgtgaggcgcgcggagccgcctcccctgggtcaggtctgatgggccggtgggcgcgctagtggtggccgccaccgccgaaaccgtcgacctcctgggccccagttccgcgtccagccccgcggcagcatg

SEQ ID NO: 1213 - DNA, 47 bp, Homo sapiens
ccccctctctatcagccgctcactccgtctcaatatgtctcaagatg

SEQ ID NO: 1214 - DNA, 173 bp, Homo sapiens
ctcccttttcctccccactccttcccaccagcgccacagcaacatcctcagagtctgagcgaactgcgcccagcgcgggcacggagcctcccaccgccagcaacctgcggccccggagaaggcagcgagcgcagtgacagcgcctcaccgccaccagctcctggaccaccatg

SEQ ID NO: 1215 - DNA, 162 bp, Homo sapiens
ctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatg

SEQ ID NO: 1216 - DNA, 225 bp, Homo sapiens
aggccttttccgcttctcttttacctccccaggtccgcccgtctgcgcccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggatg

SEQ ID NO: 1217 - DNA, 633 bp, Homo sapiens
cttcctttaccttcctcccatggtctccttccggttctcgatgcttctctgagcctaagggtttccgccactcgttcaccctccccccagctcatgatcctcctccctcccccgccctcctggtccaatctccgatctgtttagtaagaaggtgctgttccgagaagaaggaaaagggcttgacacgtattcactcggccccggacgtgggaagcaagccgtctggcttcggcctcacatcggtcttgtgctcgggacggcggcgttggcggactgatccgcggcggtgaagagaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatg

SEQ ID NO: 1218 - DNA, 169 bp, Homo sapiens
tttcctctggctcctgcgagggcttggtttagggcttcagctctctgcgttctcggctccgggaggcctcggtgattcagccacagcctctgcctcccgttgctctgtgacctgagggtattggacaatttgtagctaagactcccggataccctgaagtcgggaaatg

SEQ ID NO: 1219 - DNA, 143 bp, Homo sapiens
tgctctcttccaaggctgtaggagttctggagctgctggctggagaggagggtggacgaagctctctccagaaagacatcctgagaggacttggcagcctgcagatggcctattgtgggaccttgtgatcatgcctgaacatg

SEQ ID NO: 1220 - DNA, 190 bp, Homo sapiens
tttccctttatagcaccattgaatcccagtcctaacagaagtactgcgaatcttgtggcctcattctgaacaaaagggattagagaagaaaaatctcttgatataaggcttgaaagcaagggcaggcaatcttggttgtgaatattttctgatttttccagaaatcaagcagaagattgagctgctgatg

SEQ ID NO: 1221 - DNA, 93 bp, Homo sapiens
tgcccttcctcgccaccgggctgctctggtctcgtcggtcccctcctccgccccgtcgtcctgactctctctccctcctttcctcagaggatg

SEQ ID NO: 1222 - DNA, 378 bp, Homo sapiens
aaccctttcacctcagttttcttcactccggcatttgcagcagagcgaaaggtggtcgagtcctgaaggagggcctgatgtcttcatcattctcaaattcttgtaagctctgcgtcgggtgaaaccagacaaagccgcgagcccagggatgggagcacgcgggggacggcctgccggcggggacgacagcattgcgcctgggtgcagcagtgtgcgtctcggggaagggaagatattttaaggcgtgtctgagcagacggggaggcttttccaaacccaggcagcttcgtggcgtgtgcggtttcgacccggtcacacaaagcttcagcatgtcatgtggcttatcaggagggcagacttcaaaagctactaaaaatg

SEQ ID NO: 1223 - DNA, 1104 bp, Homo sapiens
tgtccttccgcgcggcggccgcggagagagctgcggcccgggggggcgtgcctgggatccggagcttcgctcgggcccgggaaaggcggcagtgggctgggatcgcggtgtctctgggtgtgatggccaatggctggactggctcccgccctgggcggaggaatcccgagctgtgaagcggctggaatccgggcccatgtgcttctttgtttactaagagcggaagcgatggcgggagcgggggtggggtgcggtggcggggtgcggtggcggaggtcccggtgaaatcaggggctaaggggacccaaagaaggcgggggatcataggggtggaaagaaagctgagaaccttgagaccggagtgtgaggggccaacggggaagggcgctagaattttaaactaaagtagggaccggaattcccctggggagatgttggatggccctgtgcactgccacgggctctttattcttcgctggttagaaacagacttgtgaaaaagagttatgcccactttggggagacttcgaaaaggttaagaagttcttacaagagttctaccaggatgatgaactcgggaagaagcagttcaagtatgggaaccagttggttcggctggctcatcgggaacaggtggctctgtatgtggacctggacgacgtagccgaggatgaccccgagttggtggactcaatttgtgagaatgccaggcgctacgcgaagctctttgctgatgccgtacaagagctgctgcctcagtacaaggagagggaagtggtaaataaagatgtcctggacgtttacattgagcatcggctaatgatggagcagcggagtcgggaccctgggatggtccgaagcccccagaaccagtaccctgctgaactcatgcgcagattgtgagtggtctctgtcgggaaagatgtagggattggttctccaggatcttgtttgtgactgttttctccccttagtgagctgtattttcaaggccctagcagcaacaagcctcgtgtgatccgggaagtgcgggctgactctgtggggaagttggtaactgtgcgtggaatcgtcactcgtgtctctgaagtcaaacccaagatg

SEQ ID NO: 1224 - DNA, 135 bp, Homo sapiens
tttccccctctccccctcctccgccgaccgagcagtgacttaagcaacggagcgcggtgaagctcatttttctccttcctcgcagccgcgccagggagctcgcggcgcgcggcccctgtcctccggcccgagatg

SEQ ID NO: 1225 - DNA, 463 bp, Homo sapiens
ctttctttccctctccgttttggtgggctggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatggcctctcttcagcttctggagacctcactatcctattatg

SEQ ID NO: 1226 - DNA, 453 bp, Homo sapiens
ccgccttcgccgcggaccttcagctgccgcggtcgctccgagcggcgggccgcagagatgacatttattcattttatgcatcctgggttctactggtcgtcccacctcagttcctgtagcaaagagacttgagtctgagccactaattatcacccgtgaggtttcctccccgagcaggaagcagcaggccagagctgcgctctctcagtgcactctccaaccaagcatcagtcaccactcccggtccagcccctgtggccaagagctggcgtgcaggctgcgggaggcagctggctgtgcaagaccctggcagggccctcgcctcctgagaaaccgagagtcagaaccaaagccaggctgtcctggttggagactgagccagaaagggtggctcacctcacggtgaggctgtcgagtgacctgagagcctcagaccctcacgtcagccggatg

SEQ ID NO: 1227 - DNA, 169 bp, Homo sapiens
tgttcttccgggttggaggcgcagcgccgcggggcccaagcccgggtctgccagcgcgacgtcctctcgcggccctcagggcacagcccaaggctgtcagcctcccggcccagtgatttgccttcaaggaaactggggagtcagaaaattgggaactcatatcaacatg

SEQ ID NO: 1228 - DNA, 149 bp, Homo sapiens
gtccctctccctccccaggacttctgtgactcctgggccacagaggtccaaccaggctaagggcctggggataccccctgcctggcccccttgcccaaactggcaggggggccaggctgggcagcagcccctctttcacctcaactatg

SEQ ID NO: 1229 - DNA, 52 bp, Homo sapiens
cggcccttccagaccgtctctcctcagggttggagacttcggggccaagatg

SEQ ID NO: 1230 - DNA, 771 bp, Homo sapiens
tcgcctctttagtaggtcgggtgagtgtagtgtgcagggaagagacgcgtcagcgccagggccaggcccgcccgggggcagcccggcagccgaatcttgggctactctgtcccaacagccggagcagatcagaccgaccggccctgcccgctcggtcccgcgccctccagaccctacggtctccgtttctaggggcacatggttagcggcaggcgcccacagccaatccactttgccagcctgccccttcctctgccaagagcagcttcttcagccgcgctccagttccgcagacgcctgccccaccctgctcttcccttccagggaagacggatcacgcggccaagaacgagactcgcaaactgggcatttctccgagccgggctagagcaagtagcgagactccgcgtgagagtgggaaagagccttaacaggcaaccatgttgcccagtgggttttctgtgcctttgggtgcggaccaatgaggcgcgtggggcgggacttccgcttcgcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaagagagaaagagagagtgggcagacatcgaagccaaacagcagtatcccggaagcactcatgcaactttggtggcggccactcagttttctctgccagtgtctggtgattttacaacgagatg

SEQ ID NO: 1231 - DNA, 190 bp, Homo sapiens
ccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggaacttgctactaccagcaccatg

SEQ ID NO: 1232 - DNA, 208 bp, Homo sapiens
cgctccttccctgagctcccgggctccggcagcgcgctggcggggcgccgcattgcacactctgggggcgccgcagtgttcgtgggatggggcagcgggctgcagctggcggccggaatccgcgcgcagcccgggtgcaagttctctcctgttgccctgagtgcccactcccaggccctctgtatgagtgacacttcagtctgccatg

SEQ ID NO: 1233 - DNA, 314 bp, Homo sapiens
cagtctctgctttctttttcctttcttccagaaggagatttaaccatagtagaaagaatggagaactattaactgcctttcttctgtgggctgtgattttcagaggggaatgctaagaggtgattttcaatgttgggactcaaaggtgaagacactgaaggacagaatttttggcagaggaaagatcttcttcggtcaccatacttgagttagctctagggaagtggaggtttccatttggaattctatagcttcttccaggtcatagtgtctgccccccaccttccagtatctcctgatatgcagcatgaatg

SEQ ID NO: 1234 - DNA, 65 bp, Homo sapiens
ctgtcctttcccgggagttagcgatccctcaacccctgcactgcgctagtcctaaagaggaaatg

SEQ ID NO: 1235 - DNA, 91 bp, Homo sapiens
gattctcttttgtccacagacagtcatctcaggagcagaaagaaaagagctcccaaatgctatatctattcaggggctctcaagaacaatg

SEQ ID NO: 1236 - DNA, 81 bp, Homo sapiens
actccttttctcctaaccgtcccggccaccgctgcctcagcctctgcctcccagcctctttctgagggaaaggacaagatg

SEQ ID NO: 1237 - DNA, 510 bp, Homo sapiens
aagcctttctccattttgcggtctaggaagtagcagaggccccttcctgtagggagttgccatggagacgcggtggggcaccgacggagttctaatgacggccgtgattggtgcaggatcctgctaatctcaggaaggcccgtagagaagtgaggaaaacgtggtggggggcatgcgcgatctggtaggcggtgctgccgtctgttgtacctgagaggcttgcgcatgccgacgcacggattcgaggcggggagcatgggaagaagcggccaggagtatgacctgatcattgcgaccaccgctaggggaagggaggagagggtgtagaaacggggacgagggtgggggaagggcaaggaggcgctcgagctggtgcgcggagcatcctgggagacgtagtccagcgggagggggaagtcgaagactgcgcgtgctcaggagcgcggagcggcccgctgagcgcagaggggcagacactggcctcagatacctgacctggtaccctctatg

SEQ ID NO: 1238 - DNA, 228 bp, Homo sapiens
cctcctctttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatg

SEQ ID NO: 1239 - DNA, 327 bp, Homo sapiens
cttcctctttcaacaacaaatgtgtcagttatcagcaggatccatgccgccagagtaaagctttctaccctttactccctgcaaagaaacaagagtgcttatcccagctaagctccagggtaatgttatcatgacagcttcaacttttagaccacaggcaaatgctttgttaaaactctatgctggtcattcccttcaggatttggcactcaccaacatacccttctttcaagtgaaaaggcatctcttttaatggtcctgacctttggaataggaagcatgtaccctggacagagcacttcaaactagaggaaccataaatccatg

SEQ ID NO: 1240 - DNA, 48 bp, Homo sapiens
catccttttgcctgctcccggcgaggggtggctttgatttcggcgatg

SEQ ID NO: 1241 - DNA, 26 bp, Homo sapiens
cgtcccctttccggccggtccccatg

SEQ ID NO: 1242 - DNA, 305 bp, Homo sapiens
ccctcccctccgcccgtcaccgcctccttgaagctgccgctgtcgctgctgctcgttcgagtcgcagatccttgccagcacattacagaatatttttgttgaaccttcttgagaattcagagaaactgctgagtgaccactgaacgaaaagatctaatcttaaggcttacgcctcactttgatgcccaggctggagtgctgtggctcaatcacagctcatcgcaacctcgacctcccgggctcaagtgatcctctcacctcagcgtcccgaacaggcgtgttccatccaccacatcagaacaatg

SEQ ID NO: 1243 - DNA, 414 bp, Homo sapiens
tcctctctccacttcctgctactgcaggcctctcctccgagaacagaggccaggtcatgactcactggcttcctgcaacctgacgatggcccagccagaagacaaggcacctgaagtccccacagagggggtgaggtgaacaaagcagacaggacccctctaggggtcctcagcaccctagagccacttactcgcctgcagaggacatggggggtgtggcatgtgccagagctggatacccaggatgcggaggcccttgtggggctgtggccactagggagtttcttggtcacaggacgtgaccccagccaggccctggtgttgaggtcaggacctttaccaggagaagtcaatacctaccagatccagaagattcccagaggtgtgtccctggaatcctccaacctctgcatg

SEQ ID NO: 1244 - DNA, 144 bp, Homo sapiens
ccgccttttcttcagcgtcctacccgcggcactggctgcgagcgccgggccacctgcgagtgtgcgcagggactctggacacccgcggcggcgagctgagggagcagtctccacgaggacccaggcggaccctctggcgccatg

SEQ ID NO: 1245 - DNA, 313 bp, Homo sapiens
ccgcctttccggagcgcgggcgcgcggtggcgggaatttcgcctgtttgcggtttagaccccaaagattcctgttggtggtctgggtcacaggaggcaggtttcgggagctggaaatgtgagcgggtacgacaggcaccgcgggtaaccgacgccccgggtccttgctgcagccgggtacgcgggataccggcaccccgccttctccgcccgagtgctgccaggcgtgggcctggaatctcttcacaccttctctttggagcccttaatgatacgacgaaccccaagtgtttcagaacatgaagtaaacaatg

SEQ ID NO: 1246 - DNA, 367 bp, Homo sapiens
actcctttcctttttccagtggttatcgcggcgcccaccggcctctgatctctgagtcttctccaacccacagacgttttttgttgctctggttccaggaccttctccacaactaggccattttccctgccaggtgtcctttttgacctcttgacctctgactcaaagggcctgctccccctcatgtcttcggcctggagaagagccagctcctgaaggaggcctttgataaggccggcccggtccccaagggcagagaagatgtgaagaggcttctgaaactacacaaggaccggttccgaggtgacctgcggtggatcctcttctgtgcagacctgccgtccctcatccaagaaggccctcaatg

SEQ ID NO: 1247 - DNA, 384 bp, Homo sapiens
cgcccttccggctcggcctttagttagtgaccagctcctcggcgttctgcagagcgtgggtttcagcgagttctacgtgccaggtccgcccggtgccggcttcctcgctgcccctggcggctcgtcagcccccactacccctgaacttggtcccaatggcggcccgcccctccttcacccggaccgtgggcatctgggcctcgccgaagccgtcaaggtggctgctcgggcttctagagcccgtgtccagccctttgccaccgaggcctgatcctcttttctgccctaaagaacttgccctgacagcctctggctcccgctcttgaggatcttgcttgtccaaacccagaagacagtgcatgaagccaggggacatccgccatg

SEQ ID NO: 1248 - DNA, 14 bp, Homo sapiens
ccgccttctccatg

SEQ ID NO: 1249 - DNA, 143 bp, Homo sapiens
ccgcccttttcttcgtagcctccaagggagctggaacaaaaaacgaaaccaaaacctgcctgctcgctcctctccccatcgcctgcgttccgctggttgtgggctttctgcggccgctgagggcgcgtctcccctccgccatg

SEQ ID NO: 1250 - DNA, 97 bp, Homo sapiens
caccctccttcagcccaggcaaggcctggggccctgggcagcctccaggtgcagtgccctcccgtgggccgcacccttgccactgccccagggcatg

SEQ ID NO: 1251 - DNA, 31 bp, Homo sapiens
ctttctcttccttccaccccgagggaccatg

SEQ ID NO: 1252 - DNA, 91 bp, Homo sapiens
cgctctccgcctcggcagtgccagccgccagtggtcgcacttggagggtctcgccgccagtggaaggagccaccgcccccgcccgaccatg

SEQ ID NO: 1253 - DNA, 117 bp, Homo sapiens
atttcctttcccttttttcgctcgtgtcccgccgggtggcgctcaccacctccccggaacacgcgagtctcctgtcgcggttccggtcggaattaccccgtggagcacgccgatatg

SEQ ID NO: 1254 - DNA, 63 bp, Homo sapiens
gagtctttccttagtaacctgggcgatagctgtggatgtttccaaggattgtcttcagtcatg

SEQ ID NO: 1255 - DNA, 211 bp, Homo sapiens
cttcctccataacaagccaaacgccagaccgagagtgcctccgtgcgcgagtgcccggtgtgtgcgcgccggcgagagcaggggcccgcccggctccccgcccgccgcggcccgaactcatgcagctccgagcgagcgagcggcgcccagcccagcgcctcggccgaacccctccgcagcaggctgcctgctgtttcccggggagatcatg

SEQ ID NO: 1256 - DNA, 49 bp, Homo sapiens
cctccttttcgccctcccacccgcactgcagtctccagcctgagccatg

SEQ ID NO: 1257 - DNA, 164 bp, Homo sapiens
aagcccttttcattgcaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatg

SEQ ID NO: 1258 - DNA, 832 bp, Homo sapiens
cagccttctcactcctcactgagtccactctgaacgtgctaaaatgggaaggaggcggtgttttgctgatctgttaaattcttagtgaagtttccttgatttccagtggctgctgttgtttgagtttggtttggagcaaaactgaggtagtcctaacatttctgggactgaatccaggcaagagaaagaagaaaaagaagaagaaaaagaggaggaaaaaggtagggagaaataaagggaggagagaagcacagtgaaagaaaaaaaaagtcccttttcgacatcacattcctgtgttttccctcagcctggaaaacatattaatcccagtgcttttacgcccggaaacaaagagactaagccagactatgggggaaagggagataagaaggatcctggaactttaaagagggaaagagtgagattcagaaatcgccaggactggactttaagggacgtcctgtgtcagcacaagggactggcacacacagacacacgagaccgaggagaaactgcagacaaatggagatacaaagacttagaaggacagctcctttcacctcatcctacttgtccagaaggtaaaaagacacagccagaaagaaaaggcatcggctcagctctcagatcaggacaggctgtggatctgtggcggtactctgaaagctggagctgcagcacaccccttttgtattgctcaccctcggtaaagagagagagggctgggaggaaaagtagttcatctaggaaactgtcctgggaaccaaacttctgatttcttttgcaaccctctgcattccatctctatgagccaccattggattacacaatg

SEQ ID NO: 1259 - DNA, 114 bp, Homo sapiens
cgacctctttgcgcctgcgccccccttgccagtctttcgccggcaaaaggaggacgtagaaaaggggacaccggaaactcactcttcacccggaaatggttattgaggaacatg

SEQ ID NO: 1260 - DNA, 16 bp, Homo sapiens
cgcccttctcaagatg

SEQ ID NO: 1261 - DNA, 440 bp, Homo sapiens
ctttccctgtgctgcccctgccgcgcgatggagaagagctcgagctgcgagagtcttggctcccagccggcggcggctcggccgcccagcgtggactccttgtccagttaatgtgttaagagccattgacatttgaagatcatcagaagtgaagataaaacatctcaaaaattataattgcctccacttctcattcagagaattcagtgcatacaaaatcagcttctgttgtatcatcagattccatttcaacttctgccgacaacttttctcctgatttgaggagggagtctcgctctatcccctaggctggagtgcattggcgccatctcggctcatttgcaacctctgtctcccgggttcaagcgattctcctgcctcagcttcccgaggagctgggattacaggtcctgagggagtctaacaagttagcagaaatg

SEQ ID NO: 1262 - DNA, 171 bp, Homo sapiens
cgccctctagctgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatg

SEQ ID NO: 1263 - DNA, 347 bp, Homo sapiens
gtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagacagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatg

SEQ ID NO: 1264 - DNA, 240 bp, Homo sapiens
gctcctccctgccgcctcctctcagtggatggttccaggcaccctgtctggggcagggagggcacaggcctgcacatcgaaggtggggtgggaccaggctgcccctcgccccagcatccaagtcctcccttgggcgcccgtggccctgcagactctcagggctaaggtcctctgttgctttttggttccaccttagaagaggctccgcttgactaagagtagcttgaaggaggcaccatg

SEQ ID NO: 1265 - DNA, 405 bp, Homo sapiens
atttcttttccccattttaaatgcaaagcaagacttgtgaatcatagtgtctctgctcctgggattcagaccaaatttccccccaaaattctcaggctatttgtttgaatacctgcttacagtggtacacaatgggcagctttgagaagaaaaattgataatcttcacggaagagtaatttgaatgaaattacacttgacagcctgtctccaagcaaacaagaggaacgagggagcctgagctaagctctgaggacttgcccaagccactgctgttggagcttcccaggaaaaaaaaaaaaaaaaaaaaaaaaaaaaaaaaaaaaaaaacaccagtttttccaacatctaattgagcttttgattaattccgtgtaccagattctactgaagaaaggtagccatg

SEQ ID NO: 1266 - DNA, 163 bp, Homo sapiens
ctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatg

SEQ ID NO: 1267 - DNA, 207 bp, Homo sapiens
ccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatg

SEQ ID NO: 1268 - DNA, 327 bp, Homo sapiens
ctgccctcttgcgtgccccggccacccccgggcggcttgtagccggtgcgcggggtggctggggctacgtgcagagctgtcgcggagccggaacagcagcggtgaagcccctcggctcggccgagaccgccgtgcccattgctcgcctcggttgccgccgctttagccgcagccgctgctgccgccgccgggggagaggcagcctattgtctttctccgcggcgaaggtgaggagctgtctcggctcggcccgcgggggagccccgggagccgcacggagatggaggaggacatctggacagtgagcaggaggcgcctcggcccatg

SEQ ID NO: 1269 - DNA, 183 bp, Homo sapiens
cgccctctccccgcctccttttcgggcgtcccgaggccgctccccaaccgacaaccaagaccccgcaggccacgcagccctggagccgaggccccccgacggcggaggcgcccgcgggtcccctacagccaaggtccctgagtgccagaggtggtggtgttgcttatcttctggaaccccatg

SEQ ID NO: 1270 - DNA, 106 bp, Homo sapiens
ctccctctcaaccacaataacaggcggagggtcggcgtaggtactttgaactcaagtaaacaaaagggaagattttctcgttgatactggagactgcacaacaatg

SEQ ID NO: 1271 - DNA, 74 bp, Homo sapiens
agatcttttccagcagctgctgcctgccagagaggcgccttcagagacccagcgcttacacaatacccaccatg

SEQ ID NO: 1272 - DNA, 62 bp, Homo sapiens
cctcctctccggcggcggcggcggcggcggcgggcggagtgagctgcggagcctggaatatg

SEQ ID NO: 1273 - DNA, 233 bp, Homo sapiens
gggcctctcttgtttatttatttattttccgtgggtgcctccgagtgtgcgcgcgctctcgctacccggcggggagggggtggggggagggcccgggaaaagggggagttggagccggggtcgaaacgccgcgtgacttgtaggtgagagaacgccgagccgtcgccgcagcctccgccgccgagaagcccttgttcccgctgctgggaaggagagtctgtgccgacaagatg

SEQ ID NO: 1274 - DNA, 76 bp, Homo sapiens
cagcctctaccccgctccggatccgggatctgagcgccggccgcggtgcccaggcactcccttggcgggccggatg

SEQ ID NO: 1275 - DNA, 205 bp, Homo sapiens
cggccttctcggcttctccagcttcggtaggagaggatccggcgccgaatcactgactggcacaggtgttgggatagtgtctcacttggtcacccaggctggagtgcagtggcgcaatcttagctctctacagcgtcgatcttcctcctgggctcaagcaattctcctgcttcatcctcctgagtacctaggactacagaaaatg

SEQ ID NO: 1276 - DNA, 957 bp, Homo sapiens
cagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatg

SEQ ID NO: 1277 - DNA, 425 bp, Homo sapiens
cagccttttgctctttcctttcattaaacaaacaggagatcctgaaacctggaccctgtgcaagctgcagcgccaggaggaggcagcggaggaagcagagcgcgggatgggcgcccagcggcatctgtgatcccgcgcacctccgccccacgggcgcgcgcacaaacacggacacacacatacacacactcgcgcacacactcgcacaaacacacactcgtacacgcccgcgccgctcgctcgccggcttgctctcccacgcaagcggaatgcagcagcgcctggagagcgtgtctcggaccgccgcctgaatgtacctcgctcccgggagccggacggcccagtagggcgcactggaggacgctccgctgcgggagcctggacagtttttgacggtgcagtcttgctatatggtgtgagaaatg

SEQ ID NO: 1278 - DNA, 803 bp, Homo sapiens
ctgtctttgcttcatcatctgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatg

SEQ ID NO: 1279 - DNA, 123 bp, Homo sapiens
gcgcctttcgcacgacttggagttacggtttatctgataccgcggtacccctacgcaagcaagcccacatcgacacacattcacacacgcccttcagcaccccctcccagcaccacgaccatg

SEQ ID NO: 1280 - DNA, 320 bp, Homo sapiens
cctcctcctttccctgggtgcccacatgaacagagacaccaggatgctctcctgagaccacagcaactgcagaagctgaagacatttccagaagttcaagcttccaccctctgcaggtccccactgagctgggacccaggtcatccaccccaccccaaatccctggataggaaacccctttctcctcctgctccttgtccccttcatccctgccgcccagcatcctactggcctcagcacctgtggccagaccgtccaagatcctctgaaggcccagctcttgctgtccaccccggcagtaggcaggcagcctggccatg

SEQ ID NO: 1281 - DNA, 240 bp, Homo sapiens
gcctccctcccccgcagctggggccagcggtgccaagcgcagctggacgagcggcagcagctgggcgagtgacagccccggctccgcgcgccgcggccgccagagccggcgcaggggaagcgcccgcggccccgggtgcagcagcggccgccgcctcccgcgcctccccggcccgcagcccgcggtcccgcggccccggggccggcacctctcgggctccggctccccgcgcgcaagatg

SEQ ID NO: 1282 - DNA, 45 bp, Homo sapiens
ccctccctccgcgcggggacccctggcgggcggcaggaggacatg

SEQ ID NO: 1283 - DNA, 242 bp, Homo sapiens
ccttctctggttccctgacctcagtgagacagcagccggcctggggacctgggggagacacggaggaccccctggctggagctgacccacagagtagggaatcatggctggagaattggatagcagagtaatgtttgacctctggaaacatcacttacagggcttccggtcaaaattcactaggtaggagggtcatcagctgggaagaaccggcgcctgggaaacctggctggataggtatg

SEQ ID NO: 1284 - DNA, 33 bp, Homo sapiens
cgttctttctttgctgcgtctactgcgagaatg

SEQ ID NO: 1285 - DNA, 33 bp, Homo sapiens
cggcctctaccggcgggatttgatggcgtgatg

SEQ ID NO: 1286 - DNA, 64 bp, Homo sapiens
acttccttttcctgtggcagcagccgggctgagaggagcgtggctgtctcctctctccgccatg

SEQ ID NO: 1287 - DNA, 82 bp, Homo sapiens
tggcccttttcccaccccctagcgccgctgggcctgcaggtctctgtcgagcagcggacgccggtctctgttccgcaggatg

SEQ ID NO: 1288 - DNA, 26 bp, Homo sapiens
aattctctttcccatcttgcaagatg

SEQ ID NO: 1289 - DNA, 27 bp, Homo sapiens
cttcctctttttccggctggaaccatg

SEQ ID NO: 1290 - DNA, 34 bp, Homo sapiens
ctttcctttctctctcctcccgccgcccaagatg

SEQ ID NO: 1291 - DNA, 25 bp, Homo sapiens
ctttctcttcctgctctccatcatg

SEQ ID NO: 1292 - DNA, 95 bp, Homo sapiens
cggcctctcggctttcggctcggaggaggccaaggtgcaacttccttcggtcgtcccgaatccgggttcatccgacaccagccgcctccaccatg

SEQ ID NO: 1293 - DNA, 59 bp, Homo sapiens
gcttcctttccgctcggctgttttcctgcgcaggagccgcagggccgtaggcagccatg

SEQ ID NO: 1294 - DNA, 34 bp, Homo sapiens
acttccttttttcttttttccggcgttcaagatg

SEQ ID NO: 1295 - DNA, 44 bp, Homo sapiens
cgttctctctttccggacctggccgagcaggaggcgccatcatg

SEQ ID NO: 1296 - DNA, 43 bp, Homo sapiens
acttccttttgcgggtggcggcgaacgcggagagcacgccatg

SEQ ID NO: 1297 - DNA, 35 bp, Homo sapiens
agctctttcctttcgctgctgcggccgcagccatg

SEQ ID NO: 1298 - DNA, 51 bp, Homo sapiens
gcctctttcctttcggccggaaccgccatcttccagtaattcgccaaaatg

SEQ ID NO: 1299 - DNA, 30 bp, Homo sapiens
acctccctttctaactccgctgccgccatg

SEQ ID NO: 1300 - DNA, 19 bp, Homo sapiens
agacccttttcacaagatg

SEQ ID NO: 1301 - DNA, 295 bp, Homo sapiens
cgctcttcctctttccctaagcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctaggtgatctgtgaaaatg

SEQ ID NO: 1302 - DNA, 51 bp, Homo sapiens
ttctctctttcttttcgccatcttttgtctttccgtggagctgtcgccatg

SEQ ID NO: 1303 - DNA, 49 bp, Homo sapiens
agttctcttcccttttgcggccatcaccgaagcgggagcggccaaaatg

SEQ ID NO: 1304 - DNA, 43 bp, Homo sapiens
ctttcctttttgctggtagggccgggtggttgctgccgaaatg

SEQ ID NO: 1305 - DNA, 81 bp, Homo sapiens
aagtctttcctttctcgttccccggccatcttagcggctgctgttggttgggggccgtcccgctcctaaggcaggaagatg

SEQ ID NO: 1306 - DNA, 30 bp, Homo sapiens
ccttcctttttcgtctgggctgccaacatg

SEQ ID NO: 1307 - DNA, 49 bp, Homo sapiens
cttcctctttccgtctcaggtcgccgctgcgaagggagccgccgccatg

SEQ ID NO: 1308 - DNA, 60 bp, Homo sapiens
cagcccctttctcttccggttctaggcgcttcgggagccgcggcttatggtgcagacatg

SEQ ID NO: 1309 - DNA, 34 bp, Homo sapiens
cgctcttcctttccaacttggacgctgcagaatg

SEQ ID NO: 1310 - DNA, 65 bp, Homo sapiens
ccgtcccttctctcttcctcggcgctgcctacggaggtggcagccatctccttctcggcatcatg

SEQ ID NO: 1311 - DNA, 71 bp, Homo sapiens
cgtccttctcttaccgccatcttggctcctgtggaggcctgctgggaacgggacttctaaaaggaactatg

SEQ ID NO: 1312 - DNA, 44 bp, Homo sapiens
ccttctcttccggtctttctggtctcggccgcagaagcgagatg

SEQ ID NO: 1313 - DNA, 44 bp, Homo sapiens
gcgtctcttcctttctgggctcggacctaggtcgcggcgacatg

SEQ ID NO: 1314 - DNA, 113 bp, Homo sapiens
cgttctttttcgtccttttccccggttgctgcttgctgtgagtgtctctagggtgatacgtgggtgagaaaggtcctggtccgcgccagagcccagcgcgcctcgtcgccatg

SEQ ID NO: 1315 - DNA, 57 bp, Homo sapiens
ccctcctcttcctttctccgccatcgtggtgtgttcttgactccgctgctcgccatg

SEQ ID NO: 1316 - DNA, 84 bp, Homo sapiens
aggcccttctctcgccaggcgtcctcgtggaagtgacatcgtctttaaaccctgcgtggcaatccctgacgcaccgccgtgatg

SEQ ID NO: 1317 - DNA, 105 bp, Homo sapiens
cggtccttccgaggaagctaaggctgcgttggggtgaggccctcacttcatccggcgactagcaccgcgtccggcagcgccagccctacactcgcccgcgccatg

SEQ ID NO: 1318 - DNA, 81 bp, Homo sapiens
ccttccttttcctccctgtcgccaccgaggtcgcacgcgtgagacttctccgccgcctccgccgcagacgccgccgcgatg

SEQ ID NO: 1319 - DNA, 37 bp, Homo sapiens
acttcctttcctttcagcggagcgcggcggcaagatg

SEQ ID NO: 1320 - DNA, 31 bp, Homo sapiens
ccgcccttttggctctctgaccagcaccatg

SEQ ID NO: 1321 - DNA, 30 bp, Homo sapiens
ggtcctctttccttgcctaacgcagccatg

SEQ ID NO: 1322 - DNA, 30 bp, Homo sapiens
gattctcttccgtcgcagagtttcgccatg

SEQ ID NO: 1323 - DNA, 115 bp, Homo sapiens
ttttcttcccagttaaaagtgttggcccgcggcgcgcggcctcttcctgtctgtaccagggcggcgcgtggtctacgccgagtgacagagacgctcaggctgtgttctcaggatg

SEQ ID NO: 1324 - DNA, 48 bp, Homo sapiens
ggccctcttttccgtggcgcctcggaggcgttcagctgcttcaagatg

SEQ ID NO: 1325 - DNA, 51 bp, Homo sapiens
gggtctcttcctaagccggcgctcggcaagttctcccaggagaaagccatg

SEQ ID NO: 1326 - DNA, 30 bp, Homo sapiens
gtttctctttccagccagcgccgagcgatg

SEQ ID NO: 1327 - DNA, 63 bp, Homo sapiens
gcgcctctttctcagtgaccgggtggtttgcttaggcgcagacggggaagcggagccaacatg

SEQ ID NO: 1328 - DNA, 48 bp, Homo sapiens
gctccttcctttccagccccggtaccggaccctgcagccgcagagatg

SEQ ID NO: 1329 - DNA, 36 bp, Homo sapiens
ctgcccctttctttttttcaggcggccgggaagatg

SEQ ID NO: 1330 - DNA, 89 bp, Homo sapiens
aggcctctttccctgccgccgccgagtcgcgcggaggcggaggcttgggtgcgttcaagattcaacttcacccgtaacccaccgccatg

SEQ ID NO: 1331 - DNA, 35 bp, Homo sapiens
cgctctcctttcgttgcctgatcgccgccatcatg

SEQ ID NO: 1332 - DNA, 28 bp, Homo sapiens
cgatctcttctgaggatccggcaagatg

SEQ ID NO: 1333 - DNA, 103 bp, Homo sapiens
cgtcctctttccgccatctttccgcgccggtgagtagcactctctgagagctccaatttcatccgtctgccatcggcgccatcctgcaatctaagccacaatg

SEQ ID NO: 1334 - DNA, 61 bp, Homo sapiens
ctttccttttccggttgcggcgccgcgcggtgaggttgtctagtccacgctcggagccatg

SEQ ID NO: 1335 - DNA, 42 bp, Homo sapiens
cgttccctttcccctggctggcagcgcggaggccgcacgatg

SEQ ID NO: 1336 - DNA, 136 bp, Homo sapiens
ccacccctttctttttgaggaagacgcggtcgtaagggctgaggatttttggtccgcacgctcctgctcctgactcaccgctgttcgctctcgccgaggaacaagtcggtcaggaagcccgcgcgcaacagccatg

SEQ ID NO: 1337 - DNA, 59 bp, Homo sapiens
gcttcctttctctctcgcgcgcggtgtggtggcagcaggcgcagcccagcctcgaaatg

SEQ ID NO: 1338 - DNA, 40 bp, Homo sapiens
gcttctctctttcgctcaggcccgtggcgccgacaggatg

SEQ ID NO: 1339 - DNA, 67 bp, Homo sapiens
gcttcctttttgtccgacatcttgacgaggctgcggtgtctgctgctattctccgagcttcgcaatg

SEQ ID NO: 1340 - DNA, 34 bp, Homo sapiens
ccgtctcctctctccggtccgtgcctccaagatg

SEQ ID NO: 1341 - DNA, 42 bp, Homo sapiens
cgctcctttccggcggtgacgacctacgcacacgagaacatg

SEQ ID NO: 1342 - DNA, 38 bp, Homo sapiens
actcctctccgccagaccgccgccgcgccgccatcatg

SEQ ID NO: 1343 - DNA, 41 bp, Homo sapiens
gcttcttccttttacctcgttgcactgctgagagcaagatg

SEQ ID NO: 1344 - DNA, 30 bp, Homo sapiens
cgttcttcttttccgacaaaacaccaaatg

SEQ ID NO: 1345 - DNA, 30 bp, Homo sapiens; identical to SEQ ID NO: 1344

SEQ ID NO: 1346 - DNA, 36 bp, Homo sapiens
gggtcttcttccttctcgcctaacgccgccaacatg

SEQ ID NO: 1347 - DNA, 42 bp, Homo sapiens
ctctctttccggtgtggagtctggagacgacgtgcagaaatg

SEQ ID NO: 1348 - DNA, 48 bp, Homo sapiens
gcgcctctttcccttcggtgtgccactgaagatcctggtgtcgccatg

SEQ ID NO: 1349 - DNA, 38 bp, Homo sapiens
tagtctcttttccggttagcgcggcgtgagaagccatg

SEQ ID NO: 1350 - DNA, 50 bp, Homo sapiens
tcctctttccctcggagcgggcggcggcgttggcggcttgtgcagcaatg

SEQ ID NO: 1351 - DNA, 32 bp, Homo sapiens
cctcctccttttccaagcggctgccgaagatg

SEQ ID NO: 1352 - DNA, 42 bp, Homo sapiens
cagcccttccgccacggccgtctctggagagcagcagccatg

SEQ ID NO: 1353 - DNA, 40 bp, Homo sapiens
gtttctttctttccgcgccgatagcgctcacgcaagcatg

SEQ ID NO: 1354 - DNA, 51 bp, Homo sapiens
tcgcctttctctcggccttagcgccatttttttggaaacctctgcgccatg

SEQ ID NO: 1355 - DNA, 52 bp, Homo sapiens
cgctctctcttccacaggaggcctacacgccgccgcttgtgctgcagccatg

SEQ ID NO: 1356 - DNA, 46 bp, Homo sapiens
ggttctcttttcctccttggctgtctgaagatagatcgccatcatg

SEQ ID NO: 1357 - DNA, 58 bp, Homo sapiens
tttcctctttcggccgcgctggtgaacaggtaggtcatccttgcggccttgcggcatg

SEQ ID NO: 1358 - DNA, 33 bp, Homo sapiens
cttcctcttccggggacgttgtctgcaggtatg

SEQ ID NO: 1359 - DNA, 32 bp, Homo sapiens
gtttcctcttttaccaaggacccgccaacatg

SEQ ID NO: 1360 - DNA, 85 bp, Homo sapiens; identical to SEQ ID NO: 193

SEQ ID NO: 1361 - DNA, 91 bp, Homo sapiens
cttctctctcggcgtttccgctgtcagggccctgcggtgtgactcgcgggctcagctggtccggccgtagcacctccgcgccgtcgccatg

SEQ ID NO: 1362 - DNA, 62 bp, Homo sapiens
cgctctcctcctctcacggaaaggtcgcggcctgtggccctgcgggcagccgtgccgagatg

SEQ ID NO: 1363 - DNA, 241 bp, Homo sapiens
cactcccttccaaaagcatgacaggcagaaagcagagaagggccaggactggctgagggcggggagctgggcctctggggtggacacacccttggtcacattgtgagggtagcttggttggccagtcccaccactgcagtgaccacagttgtgttgggctcacaccagtgaaccgaagctctggattctgagagtctgaggattccgtgaagatctcagacttgggctcagagcaaggatg

SEQ ID NO: 1364 - DNA, 1812 bp, Artificial Sequence
  PpLuc(GC)  agA64
gggagaaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagttataagactgactagcccgatgggcctcccaacgggccctcctcccctccttgcaccgagattaatagatctaaaaaaaaaaaaaaaaaaaaaaaaaaaaaaaaaaaaaaaaaaaaaaaaaaaaaaaaaaaaaaaa

SEQ ID NO: 1365 - DNA, 1914 bp, Artificial Sequence
  32L PpLuc(GC) ag A64 C30 histoneSL
ggggcgctgcctacggaggtggcagccatctccttctcggcatcaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagttataagactgactagcccgatgggcctcccaacgggccctcctcccctccttgcaccgagattaatagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1366 - DNA, 1848 bp, Artificial Sequence
  32L PpLuc(GC) A64N64
ggggcgctgcctacggaggtggcagccatctccttctcggcatcaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagtagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1367 - DNA, 2035 bp, Artificial Sequence
  32L PpLuc(GC) albumin7 A64N64
ggggcgctgcctacggaggtggcagccatctccttctcggcatcaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1368 - DNA, 42 bp, Artificial Sequence
  5UTR of human ribosomal protein Large 32 lacking the 5 terminal oligopyrimidine tract
ggcgctgcctacggaggtggcagccatctccttctcggcatc

SEQ ID NO: 1369 - DNA, 186 bp, Homo sapiens
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 1370 - DNA, 110 bp, Homo sapiens
gctggagcctcggtggccatgcttcttgccccttgggcctccccccagcccctcctccccttcctgcacccgtacccccgtggtctttgaataaagtctgagtgggcggc

SEQ ID NO: 1371 - DNA, 108 bp, Homo sapiens
gctggagcctcggtagccgttcctcctgcccgctgggcctcccaacgggccctcctcccctccttgcaccggcccttcctggtctttgaataaagtctgagtgggcag

SEQ ID NO: 1372 - DNA, 132 bp, Homo sapiens
gctcgctttcttgctgtccaatttctattaaaggttcctttgttccctaagtccaactactaaactgggggatattatgaagggccttgagcatctggattctgcctaataaaaaacatttattttcattgc

SEQ ID NO: 1373 - DNA, 304 bp, Homo sapiens
gtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctcta

SEQ ID NO: 1374 - DNA, 674 bp, Homo sapiens
gcgtcgccaccctttggttatttcagcccccatcacccaagccacaagctgaccccttcgtggttatagccctgccctcccaagtcccaccctcttcccatgtcccaccctccctagaggggcaccttttcatggtctctgcacccagtgaacacattttactctagaggcatcacctgggaccttactcctctttccttccttcctcctttcctatcttccttcctctctctcttcctctttcttcattcagatctatatggcaaatagccacaattatataaatcatttcaagactagaatagggggatataatacatattactccacaccttttatgaatcaaatatgatttttttgttgttgttaagacagagtctcactttgacacccaggctggagtgcagtggtgccatcaccacggctcactgcagcctcagcgtcctgggctcaaatgatcctcccacctcagcctcctgagtagctgggactacaggctcatgccatcatgcccagctaatatttttttattttcgtggagacggggcctcactatgttgcctaggctggaaataggattttgaacccaaattgagtttaacaataataaaaagttgttttacgctaaagatggaaaagaactaggactgaactattttaaataaaatattggc

SEQ ID NO: 1375 - DNA, 1406 bp, Homo sapiens
actccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttaccaaaaaaaaaaaaaaaaaaagaataaataaataactttttaaaaaaggaagcttggtccacttgcttgaagacccatgcgggggtaagtccctttctgcccgttgggcttatgaaaccccaatgctgccctttctgctcctttctccacaccccccttggggcctcccctccactccttcccaaatctgtctccccagaagacacaggaaacaatgtattgtctgcccagcaatcaaaggcaatgctcaaacacccaagtggcccccaccctcagcccgctcctgcccgcccagcacccccaggccctgggggacctggggttctcagactgccaaagaagccttgccatctggcgctcccatggctcttgcaacatctccccttcgtttttgagggggtcatgccgggggagccaccagcccctcactgggttcggaggagagtcaggaagggccacgacaaagcagaaacatcggatttggggaacgcgtgtcaatcccttgtgccgcagggctgggcgggagagactgttctgttccttgtgtaactgtgttgctgaaagactacctcgttcttgtcttgatgtgtcaccggggcaactgcctgggggcggggatgggggcagggtggaagcggctccccattttataccaaaggtgctacatctatgtgatgggtggggtggggagggaatcactggtgctatagaaattgagatgcccccccaggccagcaaatgttcctttttgttcaaagtctatttttattccttgatatttttctttttttttttttttttttgtggatggggacttgtgaatttttctaaaggtgctatttaacatgggaggagagcgtgtgcggctccagcccagcccgctgctcactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatgacccaaacataa

SEQ ID NO: 1376 - DNA, 186 bp, Homo sapiens
catcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 1377 - DNA, 256 bp, Artificial Sequence
  Human albumin 3UTR + poly(A) sequence
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctagatctaaaaaaaaaaaaaaaaaaaaaaaaaaaaaaaaaaaaaaaaaaaaaaaaaaaaaaaaaaaaaaaa

SEQ ID NO: 1378 - DNA, 155 bp, Homo sapiens
aaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaatt

SEQ ID NO: 1379 - DNA, 110 bp, Homo sapiens
catcacatttaaaagcatctcagcctaccatgagaataagagaaagaaaatgaagatcaaaagcttattcatctgtttttctttttcgttggtgtaaagccaacaccctg

SEQ ID NO: 1380 - DNA, 110 bp, Homo sapiens
aaaagcatctcagcctaccatgagaataagagaaagaaaatgaagatcaaaagcttattcatctgtttttctttttcgttggtgtaaagccaacaccctgtctaaaaaac

SEQ ID NO: 1381 - DNA, 110 bp, Homo sapiens
cagcctaccatgagaataagagaaagaaaatgaagatcaaaagcttattcatctgtttttctttttcgttggtgtaaagccaacaccctgtctaaaaaacataaatttct

SEQ ID NO: 1382 - DNA, 110 bp, Homo sapiens
tgagaataagagaaagaaaatgaagatcaaaagcttattcatctgtttttctttttcgttggtgtaaagccaacaccctgtctaaaaaacataaatttctttaatcattt

SEQ ID NO: 1383 - DNA, 110 bp, Homo sapiens
agaaagaaaatgaagatcaaaagcttattcatctgtttttctttttcgttggtgtaaagccaacaccctgtctaaaaaacataaatttctttaatcattttgcctctttt

SEQ ID NO: 1384 - DNA, 110 bp, Homo sapiens
tgaagatcaaaagcttattcatctgtttttctttttcgttggtgtaaagccaacaccctgtctaaaaaacataaatttctttaatcattttgcctcttttctctgtgctt

SEQ ID NO: 1385 - DNA, 110 bp, Homo sapiens
aagcttattcatctgtttttctttttcgttggtgtaaagccaacaccctgtctaaaaaacataaatttctttaatcattttgcctcttttctctgtgcttcaattaataa

SEQ ID NO: 1386 - DNA, 110 bp, Homo sapiens
atctgtttttctttttcgttggtgtaaagccaacaccctgtctaaaaaacataaatttctttaatcattttgcctcttttctctgtgcttcaattaataaaaaatggaaa

SEQ ID NO: 1387 - DNA, 151 bp, Homo sapiens
cagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaa

SEQ ID NO: 1388 - DNA, 121 bp, Homo sapiens
tgaagatcaaaagcttattcatctgtttttctttttcgttggtgtaaagccaacaccctgtctaaaaaacataaatttctttaatcattttgcctcttttctctgtgcttcaattaataaa

SEQ ID NO: 1389 - DNA, 91 bp, Homo sapiens
ctttttcgttggtgtaaagccaacaccctgtctaaaaaacataaatttctttaatcattttgcctcttttctctgtgcttcaattaataaa

SEQ ID NO: 1390 - DNA, 60 bp, Homo sapiens
aagcttattcatctgtttttctttttcgttggtgtaaagccaacaccctgtctaaaaaac

SEQ ID NO: 1391 - RNA, 16 nt, Artificial Sequence
  Sequence according to formula (Ic)
  misc_feature (1)..(1): n is a, u, t, g, and c, or a nucleotide analogue thereof
  misc_feature (3)..(8): n is a, u, t, g, and c, or a nucleotide analogue thereof
  misc_feature (10)..(14): n is a, u, t, g, and c, or a nucleotide analogue thereof
  misc_feature (16)..(16): n is a, u, t, g, and c, or a nucleotide analogue thereof
ngnnnnnnunnnnncn

SEQ ID NO: 1392 - RNA, 26 nt, Artificial Sequence
  Sequence according to formula (IIc)
  misc_feature (1)..(2): n is a, u, t, g, and c, or a nucleotide analogue thereof; may be present or not
  misc_feature (3)..(6): n is a, u, t, g, and c, or a nucleotide analogue thereof
  misc_feature (8)..(13): n is a, u, t, g, and c, or a nucleotide analogue thereof
  misc_feature (15)..(19): n is a, u, t, g, and c, or a nucleotide analogue thereof
  misc_feature (21)..(24): n is a, u, t, g, and c, or a nucleotide analogue thereof
  misc_feature (25)..(26): n is a, u, t, g, and c, or a nucleotide analogue thereof; may be present or not.
nnnnnngnnnnnnunnnnncnnnnnn

SEQ ID NO: 1393 - RNA, 16 nt, Artificial Sequence
  Sequence according to formula (Id)
  misc_feature (1)..(1): n is a, u, t, g, and c, or a nucleotide analogue thereof
  misc_feature (3)..(8): n is a, u, t, g, and c, or a nucleotide analogue thereof
  misc_feature (10)..(14): n is a, u, t, g, and c, or a nucleotide analogue thereof
  misc_feature (16)..(16): n is a, u, t, g, and c, or a nucleotide analogue thereof
ncnnnnnnunnnnngn

SEQ ID NO: 1394 - RNA, 26 nt, Artificial Sequence
  Sequence according to formula (IId)
  misc_feature (1)..(2): n is a, u, t, g, and c, or a nucleotide analogue thereof; may be present or not.
  misc_feature (3)..(6): n is a, u, t, g, and c, or a nucleotide analogue thereof
  misc_feature (8)..(13): n is a, u, t, g, and c, or a nucleotide analogue thereof
  misc_feature (15)..(19): n is a, u, t, g, and c, or a nucleotide analogue thereof
  misc_feature (21)..(23): n is a, u, t, g, and c, or a nucleotide analogue thereof
  misc_feature (24)..(26): n is a, u, t, g, and c, or a nucleotide analogue thereof; may be present or not
nnnnnncnnnnnnunnnnngnnnnnn

SEQ ID NO: 1395 - RNA, 16 nt, Artificial Sequence
  Sequence according to formula (Ie)
  misc_feature (3)..(8): n is a, u, t, g, and c, or a nucleotide analogue thereof
  misc_feature (10)..(14): n is a, u, t, g, and c, or a nucleotide analogue thereof
dgnnnnnnunnnnnch

SEQ ID NO: 1396 - RNA, 26 nt, Artificial Sequence
  Sequence according to formula (IIe)
  misc_feature (1)..(2): n is a, u, t, g, and c, or a nucleotide analogue thereof; may be present or not
  misc_feature (3)..(5): n is a, u, t, g, and c, or a nucleotide analogue thereof
  misc_feature (8)..(13): n is a, u, t, g, and c, or a nucleotide analogue thereof
  misc_feature (15)..(19): n is a, u, t, g, and c, or a nucleotide analogue thereof
  misc_feature (22)..(23): n is a, u, t, g, and c, or a nucleotide analogue thereof
  misc_feature (24)..(26): n is a, u, t, g, and c, or a nucleotide analogue thereof; may be present or not
nnnnndgnnnnnnunnnnnchnnnnn

SEQ ID NO: 1397 - RNA, 16 nt, Artificial Sequence
  Sequence according to formula (If)
  misc_feature (1)..(1): n is a, u, t, g, and c, or a nucleotide analogue thereof
  misc_feature (3)..(3): n is a, u, t, g, and c, or a nucleotide analogue thereof
  misc_feature (7)..(8): n is a, u, t, g, and c, or a nucleotide analogue thereof
  misc_feature (10)..(10): n is a, u, t, g, and c, or a nucleotide analogue thereof
  misc_feature (12)..(12): n is a, u, t, g, and c, or a nucleotide analogue thereof
  misc_feature (14)..(14): n is a, u, t, g, and c, or a nucleotide analogue thereof
  misc_feature (16)..(16): n is a, u, t, g, and c, or a nucleotide analogue thereof
ngnbyynnunvndncn

SEQ ID NO: 1398 - RNA, 26 nt, Artificial Sequence
  Sequence according to formula (IIf)
  misc_feature (1)..(2): n is a, u, t, g, and c, or a nucleotide analogue thereof; may be present or not
  misc_feature (3)..(6): n is a, u, t, g, and c, or a nucleotide analogue thereof
  misc_feature (8)..(8): n is a, u, t, g, and c, or a nucleotide analogue thereof
  misc_feature (12)..(13): n is a, u, t, g, and c, or a nucleotide analogue thereof
  misc_feature (15)..(15): n is a, u, t, g, and c, or a nucleotide analogue thereof
  misc_feature (17)..(17): n is a, u, t, g, and c, or a nucleotide analogue thereof
  misc_feature (19)..(19): n is a, u, t, g, and c, or a nucleotide analogue thereof
  misc_feature (21)..(23): n is a, u, t, g, and c, or a nucleotide analogue thereof
  misc_feature (24)..(26): n is a, u, t, g, and c, or a nucleotide analogue thereof; may be present or not
nnnnnngnbyynnunvndncnnnnnn

SEQ ID NO: 1399 - RNA, 16 nt, Artificial Sequence
  Sequence according to formula (Ig)
  misc_feature (1)..(1): n is a, u, t, g, and c, or a nucleotide analogue thereof
  misc_feature (8)..(8): n is a, u, t, g, and c, or a nucleotide analogue thereof
  misc_feature (16)..(16): n is a, u, t, g, and c, or a nucleotide analogue thereof
nghyyydnuhabrdcn

SEQ ID NO: 1400 - RNA, 26 nt, Artificial Sequence
  Sequence according to formula (IIg)
  misc_feature (1)..(2): n is a, u, t, g, and c, or a nucleotide analogue thereof; may be present or not
  misc_feature (4)..(6): n is a, u, t, g, and c, or a nucleotide analogue thereof
  misc_feature (13)..(13): n is a, u, t, g, and c, or a nucleotide analogue thereof
  misc_feature (21)..(23): n is a, u, t, g, and c, or a nucleotide analogue thereof
  misc_feature (24)..(25): n is a, u, t, g, and c, or a nucleotide analogue thereof; may be present or not
  misc_feature (26)..(26): may be present or not
nnhnnnghyyydnuhabrdcnnnnnh

SEQ ID NO: 1401 - RNA, 16 nt, Artificial Sequence
  Sequence according to formula (Ih)
dghycudyuhasrrcc

SEQ ID NO: 1402 - RNA, 26 nt, Artificial Sequence
  Sequence according to formula (IIh)
  misc_feature (1)..(1): n is a, u, t, g, and c, or a nucleotide analogue thereof; may be present or not
  misc_feature (2)..(2): may be present or not
  misc_feature (25)..(25): n is a, u, t, g, and c, or a nucleotide analogue thereof; may be present or not
  misc_feature (26)..(26): may be present or not
nhaahdghycudyuhasrrccvhbnh

SEQ ID NO: 1403 - DNA, 16 bp, Artificial Sequence
  Sequence according to formula (Ic)
vgyyyyhhthrvvrcb

SEQ ID NO: 1404 - DNA, 16 bp, Artificial Sequence
  Sequence according to formula (Ic)
sgyyyttytmarrrcs

SEQ ID NO: 1405 - DNA, 16 bp, Artificial Sequence
  Sequence according to formula (Ic)
sgyycttttmagrrcs

SEQ ID NO: 1406 - DNA, 16 bp, Artificial Sequence
  Sequence according to formula (Ie)
  misc_feature (3)..(5): n is a, u, t, g, and c, or a nucleotide analogue thereof
  misc_feature (7)..(8): n is a, u, t, g, and c, or a nucleotide analogue thereof
  misc_feature (12)..(14): n is a, u, t, g, and c, or a nucleotide analogue thereof
dgnnnbnnthvnnnch

SEQ ID NO: 1407 - DNA, 16 bp, Artificial Sequence
  Sequence according to formula (Ie)
  misc_feature (3)..(5): n is a, u, t, g, and c, or a nucleotide analogue thereof
  misc_feature (13)..(14): n is a, u, t, g, and c, or a nucleotide analogue thereof
rgnnnyhbthrdnncy

SEQ ID NO: 1408 - DNA, 16 bp, Artificial Sequence
  Sequence according to formula (Ie)
  misc_feature (3)..(3): n is a, u, t, g, and c, or a nucleotide analogue thereof
  misc_feature (14)..(14): n is a, u, t, g, and c, or a nucleotide analogue thereof
rgndbyhythrdhncy

SEQ ID NO: 1409 - DNA, 16 bp, Artificial Sequence
  Sequence according to formula (If)
vgyyytyhthrvrrcb

SEQ ID NO: 1410 - DNA, 16 bp, Artificial Sequence
  Sequence according to formula (If)
sgyycttytmagrrcs

SEQ ID NO: 1411 - DNA, 16 bp, Artificial Sequence
  Sequence according to formula (If)
sgyycttttmagrrcs

SEQ ID NO: 1412 - DNA, 16 bp, Artificial Sequence
  Sequence according to formula (Ig)
ggyycttythagrrcc

SEQ ID NO: 1413 - DNA, 16 bp, Artificial Sequence
  Sequence according to formula (Ig)
ggcycttytmagrgcc

SEQ ID NO: 1414 - DNA, 16 bp, Artificial Sequence
  Sequence according to formula (Ig)
ggctcttttmagrgcc

SEQ ID NO: 1415 - DNA, 16 bp, Artificial Sequence
  Sequence according to formula (Ih)
dghyctdythasrrcc

SEQ ID NO: 1416 - DNA, 16 bp, Artificial Sequence
  Sequence according to formula (Ih)
ggcyctttthagrgcc

SEQ ID NO: 1417 - DNA, 16 bp, Artificial Sequence
  Sequence according to formula (Ih)
ggcycttttmagrgcc

SEQ ID NO: 1418 - DNA, 26 bp, Artificial Sequence
  Sequence according to formula (IIc)
  misc_feature (1)..(2): may be present or not
  misc_feature (25)..(26): n is a, u, t, g, and c, or a nucleotide analogue thereof; may be present or not
hhhhvvgyyyyhhthrvvrcbvhhnn

SEQ ID NO: 1419 - DNA, 26 bp, Artificial Sequence
  Sequence according to formula (IIc)
  misc_feature (1)..(2): may be present or not
  misc_feature (25)..(26): may be present or not
mhmhmsgyyyttytmarrrcsmchhh

SEQ ID NO: 1420 - DNA, 26 bp, Artificial Sequence
  Sequence according to formula (IIc)
  misc_feature (1)..(2): may be present or not
  misc_feature (25)..(26): may be present or not
mmmmmsgyycttttmagrrcsachmh

SEQ ID NO: 1421 - DNA, 26 bp, Artificial Sequence
  Sequence according to formula (IIe)
  misc_feature (1)..(2): n is a, u, t, g, and c, or a nucleotide analogue thereof; may be present or not
  misc_feature (3)..(5): n is a, u, t, g, and c, or a nucleotide analogue thereof
  misc_feature (8)..(10): n is a, u, t, g, and c, or a nucleotide analogue thereof
  misc_feature (12)..(13): n is a, u, t, g, and c, or a nucleotide analogue thereof
  misc_feature (17)..(19): n is a, u, t, g, and c, or a nucleotide analogue thereof
  misc_feature (22)..(22): n is a, u, t, g, and c, or a nucleotide analogue thereof
  misc_feature (24)..(26): n is a, u, t, g, and c, or a nucleotide analogue thereof; may be present or not
nnnnndgnnnbnnthvnnnchnhnnn

SEQ ID NO: 1422 - DNA, 26 bp, Artificial Sequence
  Sequence according to formula (IIe)
  misc_feature (1)..(1): n is a, u, t, g, and c, or a nucleotide analogue thereof; may be present or not
  misc_feature (2)..(2): n is a, u, t, g, and c, or a nucleotide analogue thereof; may be present or not
  misc_feature (5)..(5): n is a, u, t, g, and c, or a nucleotide analogue thereof
  misc_feature (8)..(10): n is a, u, t, g, and c, or a nucleotide analogue thereof
  misc_feature (18)..(19): n is a, u, t, g, and c, or a nucleotide analogue thereof
  misc_feature (24)..(24): may be present or not
  misc_feature (25)..(26): n is a, u, t, g, and c, or a nucleotide analogue thereof; may be present or not
nnhhnrgnnnyhbthrdnncydhhnn

SEQ ID NO: 1423 - DNA, 26 bp, Artificial Sequence
  Sequence according to formula (IIe)
  misc_feature (1)..(1): n is a, u, t, g, and c, or a nucleotide analogue thereof; may be present or not
  misc_feature (2)..(2): may be present or not
  misc_feature (8)..(8): n is a, u, t, g, and c, or a nucleotide analogue thereof
  misc_feature (19)..(19): n is a, u, t, g, and c, or a nucleotide analogue thereof
  misc_feature (24)..(26): may be present or not
nhhhvrgndbyhythrdhncyrhhhh

SEQ ID NO: 1424 - DNA, 26 bp, Artificial Sequence
  Sequence according to formula (IIf)
  misc_feature (1)..(2): may be present or not
  misc_feature (25)..(25): may be present or not
  misc_feature (26)..(26): n is a, u, t, g, and c, or a nucleotide analogue thereof; may be present or not
hhmhmvgyyytyhthrvrrcbvmhhn

SEQ ID NO: 1425 - DNA, 26 bp, Artificial Sequence
  Sequence according to formula (IIf)
  misc_feature (1)..(2): may be present or not
  misc_feature (25)..(26): may be present or not
mmmmmsgyycttytmagrrcsmchhh

SEQ ID NO: 1426 - DNA, 26 bp, Artificial Sequence
  Sequence according to formula (IIf)
  misc_feature (1)..(2): may be present or not
  misc_feature (25)..(26): may be present or not
mmmmmsgyycttttmagrrcsachmh

SEQ ID NO: 1427 - DNA, 26 bp, Artificial Sequence
  Sequence according to formula (IIg)
  misc_feature (1)..(2): may be present or not
  misc_feature (24)..(25): n is a, u, t, g, and c, or a nucleotide analogue thereof; may be present or not
  misc_feature (26)..(26): may be present or not
hhmamggyycttythagrrccvhnnm

SEQ ID NO: 1428 - DNA, 26 bp, Artificial Sequence
  Sequence according to formula (IIg)
  misc_feature (1)..(2): may be present or not
  misc_feature (25)..(26): may be present or not
hhaamggcycttytmagrgccvchhm

SEQ ID NO: 1429 - DNA, 26 bp, Artificial Sequence
  Sequence according to formula (IIg)
  misc_feature (1)..(2): may be present or not
  misc_feature (24)..(26): may be present or not
mmaamggctcttttmagrgccmcymm

SEQ ID NO: 1430 - DNA, 26 bp, Artificial Sequence
  Sequence according to formula (IIh)
  misc_feature (1)..(1): n is a, u, t, g, and c, or a nucleotide analogue thereof; may be present or not
  misc_feature (2)..(2): may be present or not
  misc_feature (24)..(24): may be present or not
  misc_feature (25)..(25): n is a, u, t, g, and c, or a nucleotide analogue thereof; may be present or not
  misc_feature (26)..(26): may be present or not
nhaahdghyctdythasrrccvhbnh

SEQ ID NO: 1431 - DNA, 26 bp, Artificial Sequence
  Sequence according to formula (IIh)
  misc_feature (1)..(2): may be present or not
  misc_feature (24)..(24): may be present or not
  misc_feature (25)..(25): n is a, u, t, g, and c, or a nucleotide analogue thereof; may be present or not
  misc_feature (26)..(26): may be present or not
hhaamggcyctttthagrgccvmynm

SEQ ID NO: 1432 - DNA, 26 bp, Artificial Sequence
  Sequence according to formula (IIh)
  misc_feature (1)..(2): may be present or not
  misc_feature (24)..(26): may be present or not
hmaaaggcycttttmagrgccrmyhm

SEQ ID NO: 1433 - DNA, 24 bp, Artificial Sequence
  Specific histone stem-loop sequence
caaaggctcttttcagagccacca

SEQ ID NO: 1434 - DNA, 44 bp, Homo sapiens
gcccgatgggcctcccaacgggccctcctcccctccttgcaccg

SEQ ID NO: 1435 - DNA, 75 bp, Homo sapiens
tagtttctcctctcgaacgccaggtggagcaaccggccggataccgccacagccctggcaggcggcgctgtgatg

SEQ ID NO: 1436 - DNA, 2027 bp, Artificial Sequence
  RPL35 PpLuc(GC) albumin7 A64 C30 histoneSL
ggggagcgggcggcggcgttggcggcttgtgcagcaaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1437 - DNA, 2027 bp, Artificial Sequence
  RPL21 PpLuc(GC) albumin7 A64 C30 histoneSL
ggggccggaaccgccatcttccagtaattcgccaaaaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1438 - DNA, 2068 bp, Artificial Sequence
  ATP5A1 PpLuc(GC) albumin7 A64 C30 histoneSL
gggcggctcggccattttgtcccagtcagtccggaggctgcggctgcagaagtaccgcctgcggagtaactgcaaagaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1439 - DNA, 2055 bp, Artificial Sequence
  HSD17B4 PpLuc(GC) albumin7 A64 C30 histoneSL
gggtcccgcagtcggcgtccagcggctctgcttgttcgtgtgtgtgtcgttgcaggccttattcaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1440 - DNA, 2024 bp, Artificial Sequence
  AIG1 PpLuc(GC) albumin7 A64 C30 histoneSL
gggccgcccagccggtccaggcctctggcgaacaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1441 - DNA, 2049 bp, Artificial Sequence
  COX6C PpLuc(GC) albumin7 A64 C30 histoneSL
ggagtcaggaaggacgttggtgttgaggttagcatacgtatcaaggacagtaactaccaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1442 - DNA, 2035 bp, Artificial Sequence
  ASAH1 PpLuc(GC) albumin7 A64 C30 histoneSL
gggcctctgctggagtccggggagtggcgttggctgctagagcgaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1443 - DNA, 2027 bp, Artificial Sequence
  mRPL21 PpLuc(GC) albumin7 A64 C30 histoneSL
ggggccgccgcagccatcttccagtaactcgccaaaaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1444 - DNA, 2046 bp, Artificial Sequence
  mRPL35A PpLuc(GC) albumin7 A64 C30 histoneSL
gggccatcttggcgcctgtggaggcctgctgggaacaggacttctaacagcaagtaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1445 - DNA, 1840 bp, Artificial Sequence
  RPL35 PpLuc(GC) A64 C30 histoneSL
ggggagcgggcggcggcgttggcggcttgtgcagcaaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagtagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1446 - DNA, 1840 bp, Artificial Sequence
  RPL21 PpLuc(GC) A64 C30 histoneSL
ggggccggaaccgccatcttccagtaattcgccaaaaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagtagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1447 - DNA, 1881 bp, Artificial Sequence
  ATP5A1 PpLuc(GC) A64 - C30 histoneSL
gggcggctcggccattttgtcccagtcagtccggaggctgcggctgcagaagtaccgcctgcggagtaactgcaaagaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagtagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1448 - DNA, 1868 bp, Artificial Sequence
  HSD17B4 PpLuc(GC) A64 C30 histoneSL
gggtcccgcagtcggcgtccagcggctctgcttgttcgtgtgtgtgtcgttgcaggccttattcaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagtagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1449 - DNA, 1837 bp, Artificial Sequence
  AIG1 PpLuc(GC) A64 C30 histoneSL
gggccgcccagccggtccaggcctctggcgaacaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagtagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1450 - DNA, 1862 bp, Artificial Sequence
  COX6C PpLuc(GC) A64 C30 histoneSL
ggagtcaggaaggacgttggtgttgaggttagcatacgtatcaaggacagtaactaccaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagtagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1451 - DNA, 1848 bp, Artificial Sequence
  ASAH1 PpLuc(GC) A64 C30 histoneSL
gggcctctgctggagtccggggagtggcgttggctgctagagcgaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagtagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1452 - DNA, 34 bp, Homo sapiens
ggagcgggcggcggcgttggcggcttgtgcagca

SEQ ID NO: 1453 - DNA, 34 bp, Homo sapiens
ggccggaaccgccatcttccagtaattcgccaaa

SEQ ID NO: 1454 - DNA, 75 bp, Homo sapiens
gcggctcggccattttgtcccagtcagtccggaggctgcggctgcagaagtaccgcctgcggagtaactgcaaag

SEQ ID NO: 1455 - DNA, 62 bp, Homo sapiens
gtcccgcagtcggcgtccagcggctctgcttgttcgtgtgtgtgtcgttgcaggccttattc

SEQ ID NO: 1456 - DNA, 31 bp, Homo sapiens
gccgcccagccggtccaggcctctggcgaac

SEQ ID NO: 1457 - DNA, 56 bp, Homo sapiens
agtcaggaaggacgttggtgttgaggttagcatacgtatcaaggacagtaactacc

SEQ ID NO: 1458 - DNA, 42 bp, Homo sapiens
gcctctgctggagtccggggagtggcgttggctgctagagcg

SEQ ID NO: 1459 - DNA, 34 bp, Mus musculus
ggccgccgcagccatcttccagtaactcgccaaa

SEQ ID NO: 1460 - DNA, 53 bp, Mus musculus
gccatcttggcgcctgtggaggcctgctgggaacaggacttctaacagcaagt

SEQ ID NO: 1461 - DNA, 73 bp, Mus musculus
tcctcctttcggccgccgcagccatcttccagtaactcgccaaaatgccatcttccagtaactcgccaaaatg

SEQ ID NO: 1462 - DNA, 68 bp, Mus musculus
cttcctctttccgccatcttggcgcctgtggaggcctgctgggaacaggacttctaacagcaagtatg

SEQ ID NO: 1463 - DNA, 1850 bp, Artificial Sequence
  RPL32 PpLuc(GC) ag -64
ggggcgctgcctacggaggtggcagccatctccttctcggcatcaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagttataagactgactagcccgatgggcctcccaacgggccctcctcccctccttgcaccgagattaatagatctaaaaaaaaaaaaaaaaaaaaaaaaaaaaaaaaaaaaaaaaaaaaaaaaaaaaaaaaaaaaaaaa

SEQ ID NO: 1464 - DNA, 1873 bp, Artificial Sequence
  PpLuc(GC) ag A64 histoneSL
ggggcgctgcctacggaggtggcagccatctccttctcggcatcaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcaaaggctcttttcagagccacca

SEQ ID NO: 1465 - DNA, 2035 bp, Artificial Sequence; identical to SEQ ID NO: 1367
  PpLuc(GC) albumin7 A64 C30 histoneSL

SEQ ID NO: 1466 - DNA, 1836 bp, Artificial Sequence
  RPL35 PpLuc(GC) ag A64
ggggagcgggcggcggcgttggcggcttgtgcagcaaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaa

SEQ ID NO: 1467 - DNA, 1836 bp, Artificial Sequence
  RPL21 PpLuc(GC) ag A64
ggggccggaaccgccatcttccagtaattcgccaaaaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaa

SEQ ID NO: 1468 - DNA, 1877 bp, Artificial Sequence
  atp5a1 PpLuc(GC) -g A64
gggcggctcggccattttgtcccagtcagtccggaggctgcggctgcagaagtaccgcctgcggagtaactgcaaagaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaa

SEQ ID NO: 1469 - DNA, 1864 bp, Artificial Sequence
  HSD17B4 PpLuc(GC) ag A64
gggtcccgcagtcggcgtccagcggctctgcttgttcgtgtgtgtgtcgttgcaggccttattcaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaa

SEQ ID NO: 1470 - DNA, 1833 bp, Artificial Sequence
  AIG1 PpLuc(GC) ag A64
gggccgcccagccggtccaggcctctggcgaacaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaa

SEQ ID NO: 1471 - DNA, 1858 bp, Artificial Sequence
  COX6C PpLuc(GC) ag -64
ggagtcaggaaggacgttggtgttgaggttagcatacgtatcaaggacagtaactaccaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaa

SEQ ID NO: 1472 - DNA, 1844 bp, Artificial Sequence
  ASAH1 PpLuc(GC) ag A64
gggcctctgctggagtccggggagtggcgttggctgctagagcgaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaa

SEQ ID NO: 1473 - DNA, 1865 bp, Artificial Sequence
  RPL35 PpLuc(GC) ag A64 histoneSL
ggggagcgggcggcggcgttggcggcttgtgcagcaaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcaaaggctcttttcagagccacca

SEQ ID NO: 1474 - DNA, 1865 bp, Artificial Sequence
  RPL21 PpLuc(GC) ag A64 histoneSL
ggggccggaaccgccatcttccagtaattcgccaaaaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcaaaggctcttttcagagccacca

SEQ ID NO: 1475 - DNA, 1906 bp, Artificial Sequence
  atp5a1 PpLuc(GC) ag A64 histoneSL
gggcggctcggccattttgtcccagtcagtccggaggctgcggctgcagaagtaccgcctgcggagtaactgcaaagaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcaaaggctcttttcagagccacca

SEQ ID NO: 1476 - DNA, 1893 bp, Artificial Sequence
  HSD17B4 PpLuc(GC) ag A64 histoneSL
gggtcccgcagtcggcgtccagcggctctgcttgttcgtgtgtgtgtcgttgcaggccttattcaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcaaaggctcttttcagagccacca

SEQ ID NO: 1477 - DNA, 1862 bp, Artificial Sequence
  AIG1 PpLuc(GC) ag A64 histoneSL
gggccgcccagccggtccaggcctctggcgaacaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcaaaggctcttttcagagccacca

SEQ ID NO: 1478 - DNA, 1887 bp, Artificial Sequence
  COX6C PpLuc(GC) ag A64 histoneSL
ggagtcaggaaggacgttggtgttgaggttagcatacgtatcaaggacagtaactaccaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcaaaggctcttttcagagccacca

SEQ ID NO: 1479 - DNA, 1873 bp, Artificial Sequence
  ASAH1 PpLuc(GC) ag A64 histoneSL
gggcctctgctggagtccggggagtggcgttggctgctagagcgaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcaaaggctcttttcagagccacca

SEQ ID NO: 1480 - DNA, 1873 bp, Artificial Sequence; identical to SEQ ID NO: 1464
  RPL32 PpLuc(GC) ag A64 histoneSL

SEQ ID NO: 1481 - DNA, 2035 bp, Artificial Sequence; identical to SEQ ID NO: 1367
  RPL32 PpLuc(GC) albumin7 A64 C30 histoneSL

The invention claimed is:

1. An artificial nucleic acid molecule comprising, from 5' to 3':
   (a) a 5'-untranslated region element (5'UTR element) of a TOP gene;
   (b) at least one open reading frame (ORF); and
   (c) at least one histone stem-loop sequence.

2. The artificial nucleic acid molecule according to claim 1, wherein the 5'UTR element is from a TOP gene encoding a ribosomal protein.

3. The artificial nucleic acid molecule according to claim 2, wherein the ribosomal protein is the ribosomal protein Large 32 (RPL32), the ribosomal protein Large 35 (RPL35), the ribosomal protein Large 35A (RPL35A), the ribosomal protein Large 31 (RPL31) or the ribosomal protein Large 21 (RPL21).

4. The artificial nucleic acid molecule according to claim 1, further comprising at least one 3'UTR element of a mammalian gene positioned 3' relative to the ORF.

5. The artificial nucleic acid molecule according to claim 4, wherein the 3' UTR element comprises a 3' UTR element of a gene selected from the group consisting of an albumin gene, an α-globin gene, a β-globin gene, a tyrosine hydroxylase gene, a lipoxygenase gene, and a collagen alpha gene.

6. The artificial nucleic acid molecule according to claim 4, wherein the 3'UTR element comprises a 3'UTR element of a human albumin gene.

7. The artificial nucleic acid molecule according to claim 4, further comprising a polyadenylation signal wherein the polyadenylation signal is located within the 3'UTR element.

8. The artificial nucleic acid molecule according to claim 1, further comprising a poly(A) sequence and/or a polyadenylation signal.

9. The artificial nucleic acid molecule according to claim 8, wherein the poly(A) sequence has a length of about 20 to about 300 adenine nucleotides.

10. The artificial nucleic acid molecule according to claim 1, wherein the ORF is heterologous relative to the 5'UTR element.

11. The artificial nucleic acid molecule according to claim 1, further comprising a poly(C) sequence position 3' relative to the ORF.

12. The artificial nucleic acid molecule according to claim 1, wherein the molecule is a DNA and further comprises a promoter containing-sequence operably linked to the ORF.

13. The artificial nucleic acid molecule according to claim 1, wherein the molecule is a RNA.

14. The artificial nucleic acid molecule according to claim 13, wherein the RNA is a mRNA and comprises a 5' cap.

15. The artificial nucleic acid molecule according to claim 13, wherein the RNA comprises at least one nucleotide position that is substituted with an analogue of the nucleotide selected from the group consisting of 2-amino-6-chloropurineriboside-5'triphosphate, 2-aminoadenosine-5'-triphosphate, 2-thiocytidine-5'-triphosphate, 2-thiouridine-5'-triphosphate, 4-thiouridine-5'-triphosphate, 5-aminoallylcytidine-5'triphosphate, 5-aminoallyluridine-5'-triphosphate, 5-bromocytidine-5'-triphosphate, 5-bromouridine-5'-triphosphate, 5-iodocytidine-5'-triphosphate, 5-iodouridine-5'triphosphate, 5-methylcytidine-5'-triphosphate, 5-methyluridine-5'-triphosphate, 6-azacytidine-5'-triphosphate, 6-azauridine-5'-triphosphate, 6-chloropurineriboside-5'-triphosphate, 7-deazaadenosine-5'-triphosphate, 7-deazaguanosine-5'-triphosphate, 8-azaadenosine-5'-triphosphate, 8-azidoadenosine-5'-triphosphate, benzimidazoleriboside-5'-triphosphate, N1-methyladenosine-5'-triphosphate, N1-methylguanosine-5'-triphosphate,triphosphate,N6-methyladenosine-5'-triphosphate, 06-methylguanosine-5'-pseudouridine-5'-triphosphate, puromycin-5'-triphosphate andxanthosine-5'-triphosphate.

16. The artificial nucleic acid molecule according to claim 1, wherein one or more codon of the open reading frame is modified to a codon encoding the same amino acid but having an increased G/C content compared to the wild-type codon, thereby increasing the G/C content of the open reading frame compared to the wild type version of the open reading frame.

17. The artificial nucleic acid molecule according to claim 1, wherein the ORF encodes a human polypeptide, a tumour antigen or an infectious disease antigen.

18. The artificial nucleic acid molecule according to claim 1, wherein the ORF encodes an antibody or a portion thereof.

19. The artificial nucleic acid molecule according to claim 1, wherein the 5'UTR element is from a TOP gene encoding a protein selected from the group consisting of: the ribosomal protein Large 32 (RPL32), hydroxysteroid (17-beta) dehydrogenase 4 (HSD17B4), H+transporting, mitochondrial F1 complex, alpha subunit 1, cardiac muscle (ATP5A1), androgen-induced 1 gene (AIG1), N-acylsphingosine amidohydrolase (acid ceramidase) 1 (ASAH1), cytochrome c oxidase subunit VIc (COX6C), ATP-binding cassette, sub-family B (MDR/TAP), the ribosomal protein Large 31 (RPL21) and the ribosomal protein Large 35A (RPL35A).

20. The artificial nucleic acid molecule according to claim 4, wherein the at least one 3'UTR element comprises an mRNA-stabilizing element.

21. A pharmaceutical composition comprising a RNA molecule in accordance with claim 13 in a pharmaceutically acceptable carrier.

22. A method of expressing a polypeptide in a subject comprising administering an artificial nucleic acid molecule according to claim 1 to the subject, wherein the polypeptide is encoded by the ORF of said artificial nucleic acid molecule.

* * * * *